US012630599B2

(12) United States Patent
Ols et al.

(10) Patent No.: US 12,630,599 B2
(45) Date of Patent: May 19, 2026

(54) CA2 COMPOSITIONS AND METHODS FOR TUNABLE REGULATION

(71) Applicant: Obsidian Therapeutics, Inc., Cambridge, MA (US)

(72) Inventors: Michelle Lynn Ols, Cambridge, MA (US); Vipin Suri, Belmont, MA (US); Dexue Sun, Cambridge, MA (US); Dhruv Kam Sethi, Westwood, MA (US); Michael Schebesta, Cambridge, MA (US); Michelle Lois Fleury, Cambridge, MA (US); Kutlu Goksu Elpek, Arlington, MA (US)

(73) Assignee: OBSIDIAN THERAPEUTICS, INC., Cambridge, MA (US)

( * ) Notice: Subject to any disclaimer, the term of this patent is extended or adjusted under 35 U.S.C. 154(b) by 1079 days.

(21) Appl. No.: 17/596,277

(22) PCT Filed: Jun. 12, 2020

(86) PCT No.: PCT/US2020/037623
§ 371 (c)(1),
(2) Date: Dec. 7, 2021

(87) PCT Pub. No.: WO2020/252404
PCT Pub. Date: Dec. 17, 2020

(65) Prior Publication Data
US 2022/0267398 A1     Aug. 25, 2022

Related U.S. Application Data

(60) Provisional application No. 62/860,371, filed on Jun. 12, 2019.

(51) Int. Cl.
| | |
|---|---|
| *C07K 14/54* | (2006.01) |
| *C07K 14/705* | (2006.01) |
| *C07K 14/725* | (2006.01) |
| *C12N 9/88* | (2006.01) |

(52) U.S. Cl.
CPC ...... *C07K 14/5434* (2013.01); *C07K 14/7051* (2013.01); *C07K 14/70517* (2013.01); *C12N 9/88* (2013.01); *C12Y 402/01001* (2013.01)

(58) Field of Classification Search
CPC ........ C07K 141/70517; C07K 14/7051; C07K 14/5434; C12N 9/88; C12Y 402/01001
See application file for complete search history.

(56) References Cited

U.S. PATENT DOCUMENTS

| | | | |
|---|---|---|---|
| 5,994,104 A | 11/1999 | Anderson et al. | |
| 8,556,882 B2 | 10/2013 | Morgan et al. | |
| 9,492,482 B2 | 11/2016 | Beech et al. | |
| 11,058,725 B2 | 7/2021 | Elpek et al. | |

| | | | |
|---|---|---|---|
| 2002/0119492 A1 | 8/2002 | Chirino et al. | |
| 2004/0230380 A1 | 11/2004 | Chirino et al. | |
| 2006/0148009 A1 | 7/2006 | Barbosa et al. | |

FOREIGN PATENT DOCUMENTS

| | | | | | |
|---|---|---|---|---|---|
| CA | 3055202 A1 | 9/2018 | | | |
| WO | 2004101751 A2 | 11/2004 | | | |
| WO | 2005051975 A2 | 6/2005 | | | |
| WO | 2013041487 A1 | 3/2013 | | | |
| WO | 2014134165 A1 | 9/2014 | | | |
| WO | 2015058018 A1 | 4/2015 | | | |
| WO | 2016048903 A1 | 3/2016 | | | |
| WO | 2017062953 A1 | 4/2017 | | | |
| WO | 2017180587 A2 | 10/2017 | | | |
| WO | 2017192924 A1 | 11/2017 | | | |
| WO | 2018026872 A1 | 2/2018 | | | |
| WO | 2018160993 A1 | 9/2018 | | | |
| WO | 2018161017 A1 | 9/2018 | | | |
| WO | 2018161038 A1 | 9/2018 | | | |
| WO | 2018213731 A1 | 11/2018 | | | |
| WO | 2018231759 A1 | 12/2018 | | | |
| WO | 2018237323 A1 | 12/2018 | | | |
| WO | 2019241315 A1 | 12/2019 | | | |
| WO | WO-2020123716 A1 * | 6/2020 | ............ | A61K 35/17 |
| WO | 2020252404 A1 | 12/2020 | | | |
| WO | 2020252405 A1 | 12/2020 | | | |

OTHER PUBLICATIONS

Clarke, David M., Tip W. Loo, and D. H. MacLennan. "Functional consequences of mutations of conserved amino acids in the beta-strand domain of the Ca2 (+)-ATPase of sarcoplasmic reticulum." Journal of Biological Chemistry 265.24 (1990): 14088-14092 (Year: 1990).*

Ng, Pauline C., and Steven Henikoff. "Predicting the effects of amino acid substitutions on protein function." Annu. Rev. Genomics Hum. Genet. 7.1 (2006): 61-80). (Year: 2006).*

Ng et al. (Annu. Rev. Genomics Hum. Genet. 2006.7:61-80). (Year: 2006).*

Clark et al. (Journal of Biological Chemistry 265.24 (1990): (Year: 1990).*

33rd Annual Meeting & Pre-Conference Programs of the Society for Immunotherapy of Cancer (SITC 2018), Journal for Immunotherapy of Cancer, vol. 6, Nov. 6, 2018, pp. 1-205, XP021262326, DOI: 10.1186/S40425-018-0422-Y Abstracts P238, P721.

Banaszynski et al., A Rapid, Reversible, and Tunable Method to Regulate Protein Function in Living Cells Using Synthetic Small Molecules, Cell, vol. 126, No. 5, Sep. 8, 2006, pp. 995-1004.

Banaszynski et al., Conditional Control of Protein Function, Chemistry & Biology, vol. 13, No. 1, Jan. 2006, pp. 11-21.

(Continued)

*Primary Examiner* — Vanessa L. Ford
(74) *Attorney, Agent, or Firm* — Kilpatrick Townsend & Stockton LLP

(57) ABSTRACT

The present disclosure provides regulatable biocircuit systems. Such systems provide modular and tunable protein expression systems in support of the discovery and development of therapeutic modalities.

27 Claims, No Drawings
Specification includes a Sequence Listing.

(56)          References Cited

OTHER PUBLICATIONS

Chakrabarti et al., Plasmids Encoding Membrane-Bound IL-4 or IL-12 Strongly Costimulate DNA Vaccination Against Carcinoembryonic Antigen (CEA), Vaccine, vol. 22, Nos. 9-10, Mar. 12, 2004, pp. 1199-1205.

Cutler et al., Abscisic Acid: Emergence of a Core Signaling Network, Annual Review of Plant Biology, vol. 61, Feb. 8, 2010, pp. 651-679.

Czlapinski et al., Conditional Glycosylation in Eukaryotic Cells Using a Biocompatible Chemical Inducer of Dimerization, Journal of the American Chemical Society, vol. 130, No. 40, Oct. 2008, pp. 13186-13187.

Jahn et al., An IL12-IL2-Antibody Fusion Protein Targeting Hodgkin's Lymphoma Cells Potentiates Activation of NK and T cells for an Anti-Tumor Attack, PLoS One, vol. 7, No. 9, e44482, Sep. 2012, 13 pages.

Kerkar et al., Tumor-Specific CD8+ T Cells Expressing Interleukin-12 Eradicate Established Cancers in Lymphodepleted Hosts, Cancer Research, vol. 70, No. 17, Sep. 1, 2010, 18 pages.

Kochenderfer et al., Eradication of B-Lineage Cells and Regression of Lymphoma in a Patient Treated with Autologous T Cells Genetically Engineered to Recognize CD19, Blood, vol. 116, No. 20, Nov. 18, 2010, pp. 4099-4102.

Kochenderfer et al., Treating B-Cell Cancer with T Cells Expressing Anti-CD19 Chimeric Antigen Receptors, Nature Reviews Clinical Oncology, vol. 10, No. 5, May 2013, pp. 267-276.

Koneru et al., A phase I Clinical trial of Adoptive T Cell Therapy using IL-12 Secreting MUC-16(ecto) Directed Chimeric Antigen Receptors for Recurrent Ovarian Cancer, Journal of Translational Medicine, vol. 13, No. 102, Mar. 28, 2015, 11 pages.

Lusty et al., IL-18/IL-15/IL-12 Synergy Induces Elevated and Prolonged IFN-γ Production by Ex Vivo Expanded NK Cells Which is Not Due to Enhanced STAT4 Activation, Molecular Immunology, vol. 88, Aug. 2017, pp. 138-147.

Ma et al., A CD40 Agonist and PD-1 Antagonist Antibody Reprogram the Microenvironment of Nonimmunogenic Tumors to Allow T-Cell-Mediated Anticancer Activity, Cancer Immunology Research, vol. 7, No. 3, Mar. 2019, pp. 428-442.

Ols et al., Car-Ts Armored with Small Molecule-Regulated IL12 or CD40L Cassettes for Enhanced Activity Against Solid Tumors, Proceedings: AACR Annual Meeting 2019, Abstract LB-013, Mar. 29, 2019, 1 page.

Pan et al., Cancer Immunotherapy Using a Membrane-Bound Interleukin-12 with B7-1 Transmembrane and Cytoplasmic Domains, Molecular Therapy, vol. 20, No. 5, May 2012, pp. 927-937.

International Application No. PCT/US2020/037623, International Preliminary Report on Patentability mailed on Dec. 23, 2021, 9 pages.

International Application No. PCT/US2020/037623, International Search Report and Written Opinion mailed on Sep. 16, 2020, 12 pages.

Pegram et al., Tumor-Targeted T Cells Modified to Secrete IL-12 Eradicate Systemic Tumors Without Need for Prior Conditioning, Blood, vol. 119, No. 18, May 3, 2012, pp. 4133-4141.

Rakhit et al., Chemical Biology Strategies for Posttranslational Control of Protein Function, Chemistry & Biology, vol. 21, No. 9, Sep. 18, 2014, pp. 1238-1252.

Rosenberg et al., Adoptive Cell Therapy for the Treatment of Patients with Metastatic Melanoma, Current Opinion in Immunology, vol. 21, No. 2, Apr. 2009, pp. 233-240.

Sotillo et al., Convergence of Acquired Mutations and Alternative Splicing of CD19 Enables Resistance to CART-19 Immunotherapy, Cancer Discovery, vol. 5, No. 12, Dec. 2015, pp. 1282-1295.

Stankunas et al., Conditional Protein Alleles Using Knockin Mice and a Chemical Inducer of Dimerization, Molecular Cell, vol. 12, No. 6, Dec. 2003, pp. 1615-1624.

Suri et al., Small Molecule Regulated Cytokine Expression Enables Potent and Durable Responses to Engineered T-Cell Therapy, Blood: American Society of Hematology, vol. 132, Nov. 29, 2018, 3 pages.

Tao et al., Membrane-Bound Interleukin 12 Induced Stronger Antitumor Immunity Than Soluble Interleukin 12 Without Inducing Circulating Interferon γ, Proceedings of the American Association for Cancer Research, vol. 65, No. 9, May 2005, pp. 1-4.

Weinstein-Marom et al., Membrane-Attached Cytokines Expressed by mRNA Electroporation Act as Potent T-Cell Adjuvants, Journal of Immunotherapy, vol. 39, No. 2, Feb.-Mar. 2016, pp. 60-70.

Yeku et al., Armored CART Cells Enhance Antitumor Efficacy and Overcome the Tumor Microenvironment, Scientific Reports, vol. 7, No. 10541, Sep. 5, 2017, 14 pages.

Zhang et al., Improving Adoptive T Cell Therapy by Targeting and Controlling IL-12 Expression to the Tumor Environment, Molecular Therapy, vol. 19, No. 4, Apr. 2011, pp. 751-759.

Zhang et al., Tumor-infiltrating Lymphocytes Genetically Engineered with an Inducible Gene Encoding Interleukin-12 for the Immunotherapy of Metastatic Melanoma, Clinical Cancer Research, vol. 21, No. 10, May 15, 2015, pp. 2278-2288.

EP Patent Application No. 20736504.0, Examination Report mailed Apr. 26, 2024, 8 pages.

* cited by examiner

CA2 COMPOSITIONS AND METHODS FOR TUNABLE REGULATION

CROSS REFERENCE TO RELATED APPLICATIONS

This application claims benefit of priority to U.S. Provisional Application No. 62/860,371, filed Jun. 12, 2019. The entire contents of the aforementioned application are incorporated herein by reference in their entireties.

REFERENCE TO THE SEQUENCE LISTING

The instant application contains a Sequence Listing which has been submitted electronically in ASCII format and is hereby incorporated by reference in its entirety. Said ASCII file, created on Jun. 11, 2020, is named 268052_469000_SL.txt and is 10,301,491 bytes in size.

FIELD

The present disclosure relates to destabilizing domains (DDs) derived from human carbonic anhydrase 2 (CA2) which can tune protein stability for at least one payload, and compositions and methods of use thereof. Provided in the present disclosure include polypeptides of CA2 biocircuit systems, CA2 effector modules, stimulus response elements (SREs), polynucleotides encoding the same, vectors and cells containing the polypeptides and/or polynucleotides for use in cancer immunotherapy.

BACKGROUND

Gene and cell therapies are revolutionizing medicine and offering new promise for the treatment of previously intractable conditions. However, most current technologies do not allow titration of the timing or levels of target protein induction. This has rendered many potential gene- and cell therapy applications difficult or impossible to safely and effectively deploy.

Inadequate exogenous and/or endogenous gene control is a critical issue in many gene and cell therapy settings. This lack of tunability also makes it difficult to safely express proteins with narrow or uncertain therapeutic windows or those requiring more titrated or transient expression.

One approach to regulated protein expression or function is the use of Destabilizing Domains (DDs). Destabilizing domains are small protein domains that can be appended to a target protein of interest. DDs render the attached protein of interest unstable in the absence of a DD-binding ligand and—the protein of interest—is rapidly degraded by the ubiquitin-proteasome system of the cell. However, when a specific small molecule DD-binding ligand binds to the DD, the attached protein of interest is stabilized, and protein function is achieved.

DD technology forms the basis of a new class of cell and gene therapies that can deliver tunable and temporal control of gene expression and function, expanding the universe of protein therapeutics that can be safely and effectively incorporated into cell and gene therapy modalities.

SUMMARY

The present disclosure provides novel protein domains derived from human carbonic anhydrase 2 (CA2) displaying small molecule dependent stability. Such protein domains are called destabilizing domains (DDs). In the absence of its binding ligand, the DD is destabilizing and causes degradation of a payload fused to the DD (e.g., a protein of interest (POI), while in the presence of its binding ligand, the fused DD and payload can be stabilized, and its stability is dose dependent.

Provided herein are biocircuit systems comprising at least one effector module. The effector module may include (a) a stimulus response element (SRE) which may include in whole or in part, the human carbonic anhydrase 2 such as but not limited to (CA2; SEQ ID NO. 5810) and (b) at least one payload, said at least one payload which is attached, appended or associated with said SRE. The payload may be whole or a portion of IL12, for example, membrane bound IL12 (mbIL12).

In some embodiments, the present disclosure provides stimulus response element (SRE) which may comprise a destabilizing domain (DD) derived from human carbonic anhydrase 2 (CA2; SEQ ID NO. 5810), in whole or in part. In one embodiment, the DD may include the whole CA2 (SEQ ID NO. 5810). In another embodiment, the DD may include amino acids 2 to 260 of CA2, such as but not limited to amino acids 2 to 260 of SEQ ID NO. 5810.

In one aspect, the present disclosure provides a polypeptide comprising an effector module, said effector module comprising: (i) a stimulus response element (SRE), wherein the SRE comprises a drug responsive domain (DRD), said DRD comprising human carbonic anhydrase 2 (CA2; SEQ ID NO. 5810) or a region thereof, and further comprising one or more mutations relative to the amino acid sequence of SEQ ID NO. 5810; and (ii) at least one payload which is operably linked to the SRE, wherein the payload comprises Interleukin 12 (IL12).

In some embodiments, the DRD is C-terminally located to the payload.

In some embodiments, the DRD is separated from the payload by a linker.

In one embodiment, the DRD comprises a H122Y mutation in the amino acid at position 122 (H122) of SEQ ID NO. 5810. In another embodiment, the DRD further comprises: (i) a R27L mutation in the amino acid at position 27 (R27) of SEQ ID NO. 5810; (ii) a T87I mutation in the amino acid at position 87 (T87) of SEQ ID NO. 5810; (iii) a N252D mutation in the amino acid at position 252 (N252) of SEQ ID NO. 5810; or (iv) a combination of (i), (ii) and/or (iii).

In one embodiment, the DRD comprises a E106D mutation in the amino acid at position 106 (E106) of SEQ ID NO. 5810. In one embodiment, the DRD comprises a W208S mutation in the amino acid at position 208 (W208) of SEQ ID NO. 5810. In one embodiment, the DRD comprises a E106D mutation or a W208S mutation and further comprises a C205S mutation in the amino acid at position 205 (C205) of SEQ ID NO. 5810.

In one embodiment, the DRD comprises a I59N mutation in the amino acid at position 59 (I59) of SEQ ID NO. 5810. In another embodiment, the DRD further comprises a G102R mutation in the amino acid at position 102 (G102) of SEQ ID NO. 5810.

In one embodiment, the DRD comprises a L156H mutation in the amino acid at position 156 (L156) of SEQ ID NO. 5810. In another embodiment, the DRD further comprises: (i) a W4Y mutation in the amino acid at position 4 (W4) of SEQ ID NO. 5810; (ii) a F225L mutation in the amino acid at position 225 (F225) of SEQ ID NO. 5810; (iii) deletion of amino acids at positions 257-260 of SEQ ID NO. 5810; (iv) deletion of amino acids at positions 1-5 of SEQ ID NO. 5810; or (v) deletion of amino acids G234, E235 and P236 of SEQ ID NO. 5810. In another embodiment, the DRD comprises four mutations relative to SEQ ID NO. 5810, said mutations corresponding to: (i) L156H, S172C, F178Y, and E186D; or (ii) D70N, D74N, D100N, and L156H.

In one embodiment, the DRD comprises a first mutation and a second mutation relative to SEQ ID NO. 5810, wherein: (i) the first mutation is a S73N mutation in the amino acid at position 73 (S73) of SEQ ID NO. 5810; and (ii) the second mutation is a substitution of F or Y at the amino acid position 89 (R89) of SEQ ID NO. 5810.

In one embodiment, the DRD comprises a substitution of N or F at the amino acid position 56 (S56) of SEQ ID NO. 5810. In one embodiment, the DRD comprises two substitutions relative to SEQ ID NO. 5810 that correspond to 556F and D71S.

In one embodiment, the DRD comprises one or more substitutions relative to SEQ ID NO. 5810, wherein at least one substitution is a substitution of D or N at the amino acid position 63 (G63) of SEQ ID NO. 5810, and wherein the one or more substitutions correspond to: G63D; G63D and M240L; G63D, E69V and N231I; or T55K, G63N and Q248N.

In one embodiment, the DRD comprises two or more substitutions relative to SEQ ID NO. 5810, wherein one of the two or more substitutions is a substitution of L or K at the amino acid position 71 (D71) of SEQ ID NO. 5810, and wherein said two or more substitutions correspond to: D71L and T87N; D71L and L250R; D71L, T87N and L250R; or D71K and T192F.

In one embodiment, the DRD comprises two or more substitutions relative to SEQ ID NO. 5810, wherein at least one of the two or more substitutions is: (i) a substitution of F at the amino acid position 241 (V241) of SEQ ID NO. 5810; or (ii) a substitution of F or L at the amino acid position 249 (P249) of SEQ ID NO. 5810; and wherein the two or more substitutions correspond to: D72F and V241F; D72F and P249L; D72F and P249F; D72F, V241F and P249L; A77I and P249F; or V241F and P249L.

In one embodiment, the DRD comprises one or more substitutions relative to SEQ ID NO. 5810, selected from Y51T, L183S, Y193I, L197P and the combination of V134F and L228F.

In some embodiments, the DRD comprises the region of human CA2 corresponding to amino acids 2 to 260 of SEQ ID NO. 5810.

In some embodiments, the DRD comprises the region of human CA2 corresponding to full-length CA2 comprising amino acids 1 to 260 of SEQ ID NO. 5810.

In some embodiments, the SRE is responsive to one or more stimuli. In some embodiments, the stimulus is a small molecule, wherein the small molecule is selected from Acetazolamide, Celecoxib, Valdecoxib, Rofecoxib, Methazlamide, Dorzolamide, Brinzolamide, Diclofenamide, Ethoxzolamide, Zonisamide, Dansylamide, or Dichlorphenamide. In some embodiments, the small molecule is Acetazolamide.

In some embodiments, the payload is a membrane-associated Interleukin 12 (IL12). In some embodiments, the membrane-associated IL12 is a fusion protein, said fusion protein comprising (a) Interleukin-12 subunit beta (p40); (b) Interleukin-12 subunit alpha (p35); (c) at least one linker, and (d) a transmembrane domain. In some embodiments, the fusion protein comprises, from the N-terminus, p40-linker-p35-transmembrane domain. In some embodiments, the fusion protein comprises, from the N-terminus, p40-linker-p35-transmembrane domain and further comprises a linker between p35 and the transmembrane domain.

In some embodiments, the p40 comprises the amino acid sequence of SEQ ID NO. 4.

In some embodiments, the p35 comprises an amino acid sequence selected from SEQ ID NO. 5777 or SEQ ID NO. 5798.

In some embodiments, the membrane-associated IL12 further comprises a leader sequence. For example, the leader sequence comprises an amino acid sequence selected from SEQ ID NO. 3024 or SEQ ID NO. 6006.

In some embodiments, the p40 comprises an amino acid sequence selected from SEQ ID NO. 5763 or SEQ ID NO. 5774.

In some embodiments, the transmembrane domain of the membrane-associated IL12 fusion protein is selected from a CD8α transmembrane domain or a B7-1 transmembrane domain.

In some embodiments, the membrane-associated IL12 fusion protein further comprises a hinge domain. For example, the hinge domain is selected from a CD8α hinge domain or a B7-1 hinge domain.

In some embodiments, the at least one linker of the membrane-associated IL12 fusion protein comprises one or more Glycine (G) and/or Serine (S) residues.

In some embodiments, the at least one linker of the membrane-associated IL12 fusion protein comprises a B7-1 C2 domain or an IgG1 Fc domain.

In some embodiments, the membrane-associated IL12 further comprises a cytoplasmic tail domain. For example, the cytoplasmic tail domain is selected from a CD8α tail, a B7-1 tail, and a 4-1BB intracellular domain.

In various embodiments, the effector module polypeptide of the present disclosure further comprises a signal peptide, a targeting and/or penetrating peptide, a linker, a protein tag, and/or a protein cleavage site.

In some embodiments, the present disclosure provides a composition comprising any of the polypeptides described herein.

In some embodiments, the present disclosure provides a polynucleotide encoding any of the polypeptides as described herein, wherein the polynucleotide is a DNA molecule or an RNA molecule. In some embodiments, the polynucleotide is monocistronic, bicistronic or multicistronic.

In some embodiments, the polynucleotide is bicistronic or multicistronic and encodes one or more additional polypeptides. In one embodiment, the one or more additional polypeptides are operably linked to a second SRE. In another embodiment, the one or more additional polypeptides are not operably linked to any SRE.

In some embodiments, the polynucleotide of the present disclosure is bicistronic and encodes a second polypeptide, said second polypeptide comprising a chimeric antigen receptor (CAR). In some embodiments, the second polypeptide is operably linked to a second SRE. In some embodiments, the second polypeptide is not operably linked to any SRE. In some embodiments, the second polypeptide is expressed both in the presence and absence of a stimulus to which the SRE is responsive. In some embodiments, the CAR is a CD19 CAR. In some embodiments, the CAR comprises: (a) a single chain variable fragment (scFv); (b) a transmembrane domain; (c) an intracellular signaling domain; and (d) optionally one or more co-stimulatory domains.

In some embodiments, the present disclosure provides a vector comprising a polynucleotide as described herein. In some embodiments, the vector is a viral vector or a plasmid. For example, a viral vector may be a retroviral vector, a lentiviral vector, a gamma-retroviral vector, a recombinant AAV vector, an adenoviral vector, or an oncolytic viral vector.

In some embodiments, the present disclosure provides a cell comprising at least one of: the effector module, the polynucleotide, or the vector as described herein.

In some embodiments, the present disclosure provides a cell transduced or transfected with a vector as described herein.

In some embodiments, a cell of the present disclosure is an immune cell for adoptive cell transfer (ACT) or is a CD8+ T cell, a CD4+ T cell, a helper T cell, a natural killer (NK) cell, a NKT cell, a cytotoxic T lymphocyte (CTL), a tumor infiltrating lymphocyte (TIL), a memory T cell, a regulatory T (Treg) cell, a cytokine-induced killer (CIK) cell, a dendritic cell, lymphokine activated killer (LAK) cells, a human embryonic stem cell, a mesenchymal stem cell, a hematopoietic stem cell, or a mixture thereof. In some embodiments, the cell is modified to express a chimeric antigen receptor (CAR) or an antigen-specific T cell receptor (TCR) and variants thereof. In some embodiments, the cell is a T cell or NK cell.

In some embodiments, the present disclosure provides a cell which expresses the effector module and/or comprises the polynucleotide and/or is infected or transfected with the vector as described herein, wherein said cell is a T cell modified to express an antigen-specific T cell receptor (TCR) and variants thereof or an antigen-specific chimeric antigen receptor (CAR).

In some embodiments, the present disclosure provides a method of modulating expression, function, and/or level of a payload in a cell of the present disclosure, said method comprising administering to the cell a stimulus, wherein the SRE is responsive to the stimulus and wherein the expression, function, and/or level of the at least one payload is modulated in response to the stimulus.

In some embodiments, the present disclosure provides a pharmaceutical composition comprising the polypeptide, the polynucleotide, the vector, or the cell as described herein and a pharmaceutically acceptable excipient.

In some embodiments, the present disclosure provides a method of producing a modified cell, said method comprising introducing into a cell a nucleic acid molecule comprising a polynucleotide that comprises an effector module of the present disclosure.

In one aspect, the present disclosure provides a method of producing a modified cell, said method comprising introducing into a cell: (i) a first polynucleotide encoding an effector module, wherein said effector module comprises: (a) a stimulus response element (SRE), wherein the SRE comprises a drug responsive domain (DRD), said DRD comprising human carbonic anhydrase 2 (CA2; SEQ ID NO. 5810) or a region thereof, and further comprising one or more mutations relative to the amino acid sequence of SEQ ID NO. 5810; and (b) at least one payload which is operably linked to the SRE, wherein the payload comprises membrane-associated Interleukin 12 (IL12); wherein the DRD is stabilized in the presence of a stimulus and enables expression of the membrane-associated IL12, and wherein expression of the membrane-associated IL12 in the cell is significantly increased in the presence of the stimulus as compared to expression of the membrane-associated IL12 in the absence of the stimulus; and (ii) optionally, a second polynucleotide encoding a CD19 chimeric antigen receptor (CAR). In some embodiments, the cell is a T-cell or NK cell.

In some embodiments, the present disclosure provides a method of treating a disease and/or inducing an immune response in a subject in need thereof, said method comprising: (a) administering to the subject a therapeutically effective amount of a polypeptide, polynucleotide, vector or cell as described herein; and (b) administering to the subject a therapeutically effective amount of a stimulus, wherein the SRE is responsive to the stimulus and wherein expression of the at least one payload is modulated in response to the stimulus to thereby treat the disease and/or induce an immune response. In some embodiments, the disease is cancer. In some embodiments, the stimulus is selected from Acetazolamide, Celecoxib, Valdecoxib, Rofecoxib, Methazolamide, Dorzolamide, Brinzolamide, Diclofenamide, Ethoxzolamide, Zonisamide, Dansylamide, or Dichlorphenamide.

In another aspect, the present disclosure provides an engineered cell comprising: (i) a first polynucleotide which encodes a first polypeptide, said first polypeptide comprising: (a) a first stimulus response element (SRE), wherein the first SRE comprises a drug responsive domain (DRD), said DRD comprising human carbonic anhydrase 2 (CA2; SEQ ID NO. 5810) or a region thereof, and further comprising one or more mutations relative to the amino acid sequence of SEQ ID NO. 5810; and (b) a first payload which is operably linked to the first SRE, wherein the first payload comprises membrane-associated Interleukin 12 (IL12); and (ii) a second polynucleotide which encodes one or more additional polypeptides, said one or more additional polypeptides comprising an immunotherapeutic agent selected from the group consisting of: a T cell receptor (TCR) and variants thereof and a chimeric antigen receptor (CAR); wherein the DRD and the first payload am destabilized in the absence of a first stimulus and wherein the DRD and the first payload are stabilized in the presence of the first stimulus, and the one or more additional polypeptides are expressed independently of the first payload. In some embodiments, the one or more additional polypeptides are linked to a second SRE comprising a second DRD, wherein the second DRD is the same or different as the DRD in the first SRE, the second DRD and the one or more additional polypeptides are destabilized in the absence of the first or a second stimulus and wherein the second DRD and the one or more additional polypeptides are stabilized in the presence of the first or the second stimulus.

In some embodiments, the present disclosure provides a DD comprising a region of or the whole human carbonic anhydrase 2 (CA2; SEQ ID NO. 5810), and further comprising a mutation relative to SEQ ID NO. 5810 selected from A115L, A116Q, A116V, A133L, A133T, A141P, A152D, A152L, A152R, A173C, A173G, A173L, A173T, A23P, A247L, A247S, A257L, A257S, A38P, A38V, A54Q, A54V, A54X, A65L, A65N, A65V, A77I, A77P, A77Q, C205M, C205R, C205V, C205W, C205Y, D101G, D101M, D110I, D129I, D138G, D138M, D138N, D161*, D161M, D161V, D164G, D164I, D174*, D174T, D179E, D179I, D179R, D189G, D189I, D19T, D19V, D242G, D242T, D32T, D34T, D41T, D52I, D52L, D71F, D71G, D71K, D71M, D71S, D71Y, D72I, D72S, D72T, D72X, D75T, D75V, D85M, E106D, E106G, E106S, E117*, E117N, E14N, E186*, E186N, E204A, E204D, E204G, E204N, E213*, E213G, E213N, E220K, E220R, E220S, E233D, E233G, E233R, E235*, E235G, E235N, E237K, E237R, E238*, E238N, E238R, E26S, E69D, E69K, E69S, F130L, F146V, F175I, F175L, F175S, F178L, F178S, F20L, F20S, F225I, F225L, F225S, F225Y, F230I, F230L, F230S, F259L, F259S, F66S, F70I, F70L, F95Y, G102D, G104R, G104V, G128R, G12D, G12E, G131E, G131R, G131W, G139D, G144D, G144V, G150A, G150S, G150W, G155A, G155C, G155D, G155S, G170A, G170D, G182A, G182W, G195A, G195R, G232R, G232W, G234L, G234V, G25E, G63D, G63V, G81E, G81V, G82D, G86A, G86D, G98V, H107I, H107Q, H119T, H119Y, H122T, H122Y, H15L, H15T, H15Y, H17D, H17I, H36I, H36Q, H64M, H94T, H % T, I145F, I145M, I166H, I166L, I209D, I209L, I215H, I215S, I22L, I255N, I255S, I33S, I59F, I59N, I59S, I91F, K111E, K111N, K112R, K113I, K113N, K126N, K132E, K132R, K148E, K148R, K153*, K153N, K158E, K158N, K167*, K169N, K169R, K171Q, K171R, K18R, K212N, K212Q, K212R, K212W, K224E, K224N, K227*, K227N, K24R, K251E, K251R, K256Q, K260F, K260L, K260Q, K39S, K45N, K45S, K80M, K80R, L118F, L120W, L140V, L140W, L143*, L147*, L147F, L156F, L156H, L156P, L156Q, L163A, L163W, L183P, L183S, L184F, L184P, L188P, L188W, L197*, L197M, L197P, L197R, L197T, L202F, L202H, L202I, L202P, L202R, L202S, L203P, L203S, L203W, L211*, L211A, L211S, L223*, L223I, L223V, L228F, L228H, L228T, L239*, L239F, L239T, L250*, L250P, L250T, L44*, L44M, L47C, L47V, L57*, L57X, L60S, L79F, L79S, L84W, L90*, L90V, M240D, M240L, M240R, M240W, N11D, N11K, N124T, N177*, N177T, N229*, N229T, N231D, N231F, N231K, N231L, N231M, N231Q, N231T, N243Q, N243T, N252E, N252T, N61R, N61T, N61Y, N62K, N62M, N67D, N67T, P137L, P13A, P13H, P13L, P13S, P154L, P154R, P154T, P180L, P180S, P185L, P185S, P185V, P194Q, P200A, P200L, P200S, P200T, P201A, P201L, P201R, P201S, P214T, P236L, P236T, P246L, P246Q, P249A, P249F, P249H, P249I, P249X, P30L, P30S, P42L, P83A, Q103K, Q135S, Q136N, Q157R, Q157S, Q221A, Q221R, Q248F, Q248L, Q248S, Q254A, Q254K, Q28S, Q53H, Q53K, Q53N, Q74R, Q92H, Q92S, R181H, R181S, R181V, R226H, R226P, R226V, R245A, R253G, R253Q, R27A, R58G, R89D, R89F, R89I, R89X, R89Y, S105L, S105Q, S151A, S151I, S151Q, S165F, S165P, S172E, S172V, S187I, S187P, S196H, S196L, S216A, S216Q, S218A, S218Q, S219A, S219Q, S258F, S258P, S29C, S29P, S43P, S43T, S48L, S50P, S56F, S56N, S56P, S56X, S73L, S73N, S73X, S99H, T108L, T125I, T125P, T168K, T168N, T168Q, T176H, T176L, T192D, T192F, T192I, T192N, T192P, T192X, T198D, T198I, T198P, T199A, T199H, T199P, T207D, T207I, T207P, T207S, T35I, T35L, T37Q, T55L, T7L, V109M, V109W, V12IF, V134C, V134F, V142F, V149Q, V149L, V159L, V159S, V160C, V160L, V162A, V162C, V206*, V206C, V206M, V210C, V217L, V217R, V217S, V222A, V222C, V222G, V241G, V241W, V241X, V31L, V49F, V68L, V68W, V78C, W123G, W123R, W16G, W191*, W191G, W191L, W208G, W208L, W208S, W244*, W244G, W244L, W97C, W97G, Y114H, Y114M, Y127M, Y190*, Y190L, Y190T, Y193C, Y193F, Y193I, Y193L, Y193T, Y193V, Y193X, Y40M, Y51F, Y51M, Y51T, Y51X, Y88T, K9N, and S29A. As used herein, "*" indicates the translation of the stop codon and "X" indicates any amino acid.

In some embodiments, the present disclosure provides a DD comprising a region of or the whole human carbonic anhydrase 2 (CA2; SEQ ID NO. 5810), and further comprising a mutation relative to SEQ ID NO. 5810 selected from E106D, G63D, H122Y, I59N, L156H, L183S, L197P, S56F, S56N, W208S, Y193I, and Y51T.

In some embodiments, the present disclosure provides a DD comprising a region of or the whole human carbonic anhydrase 2 (CA2; SEQ ID NO. 5810), and further comprising two or more mutations relative to SEQ ID NO. 5810. In some embodiments, a DD may comprise CA2 (aa 2-260 of WT, R27L, H122Y), CA2 (aa 2-260 of WT, T87I, H122Y), CA2 (aa 2-260 of WT, H122Y, N252D), CA2 (aa 2-260 of WT, D72F, V241F), CA2 (aa 2-260 of WT, V241F, P249L), CA2 (aa 2-260 of WT, D72F, P249L), CA2 (aa 2-260 of WT, D71L, L250R), CA2 (aa 2-260 of WT, D72F, P249F), CA2 (aa 2-260 of WT, T55K, G63N, Q248N), CA2 (aa 2-260 of WT, L156H, A257del, S258del, F259del, K260del), CA2 (aa 2-260 of WT, L156H, S2del, H3del, H4del, W5del), CA2 (aa 2-260 of WT, W4Y, L156H), CA2 (aa 2-260 of WT, L156H, G234del, E235del, P236del), CA2 (aa 2-260 of WT, L156H, F225L), CA2 (aa 2-260 of WT, D70N, D74N, D100N, L156H), (CA2 (a 2-260 of WT, I59N, G102R), CA2 (aa 2-260 of WT, G63D, E69V, N231I), CA2 (aa 2-260 of WT, R27L, T87I, H122Y, N252D), CA2 (aa 2-260 of WT, D72F, V241F, P249L), CA2 (aa 2-260 of WT, D71L, T87N, L250R), CA2 (aa 2-260 of WT, L156H, S172C, F178Y, E186D), CA2 (a 2-260 of WT, D71F, N231F), CA2 (aa 2-260 of WT, A77I, P249F), CA2 (aa 2-260 of WT, D71K, P249H), CA2 (aa 2-260 of WT, D72F, P249H), CA2 (aa 2-260 of WT, Q53N, N61Y), CA2 (aa 2-260 of WT, E106D, C205S), CA2 (aa 2-260 of WT, C205S, W208S), CA2 (aa 2-260 of WT, S73N, R89Y), CA2 (aa 2-260 of WT, D71K, T192F), CA2 (aa 2-260 of WT, Y193L, K260L), CA2 (aa 2-260 of WT, D71F, V241F, P249L), CA2 (aa 2-260 of WT, L147F, Q248F), CA2 (aa 2-260 of WT, D52I, S258P), CA2 (a 2-260 of WT, D72S, T192N), CA2 (a 2-260 of WT, D179E, T192I), CA2 (aa 2-260 of WT, S56N, Q103K), CA2 (a 2-260 of WT, D71Y, Q248L), CA2 (a 2-260 of WT, S73N, R89F), CA2 (a 2-260 of WT, D71K, N231L, E235G, L239F), CA2 (aa 2-260 of WT, D72F, P249I), CA2 (aa 2-260 of WT, D72X, V241X, P249X), CA2 (aa 2-260 of WT, A54X, S56X, L57X, T192X), CA2 (aa 2-260 of WT, Y193V, K260F), CA2 (a 2-260 of WT, G63D, M240L), CA2 (a 2-260 of WT, V134F, L228F), CA2 (a 2-260 of WT, D71G, N231K), CA2 (a 2-260 of WT, S56F, D71S), CA2 (a 2-260 of WT, D52L, G128R, Q248F), CA2 (aa 2-260 of WT, S73X, R89X), CA2 (a 2-260 of WT, Y51X, D72X, V241X, P249X), CA2 (a 2-260 of WT, D72I, W97C), CA2 (aa 2-260 of WT, D71K, T192F, N231F), CA2 (aa 2-260 of WT, H36Q, S43T, Y51F, N67D, G131W, R226H), CA2 (a 2-260 of WT, F70I, F146V), CA2 (aa 2-260 of WT, K45N, V68L, H119Y, K169R, D179E), CA2 (aa 2-260 of WT, H15L, A54V, K111E, E220K, F225I), CA2 (aa 2-260 of WT, P13S, P83A, D101G, K111N, F230I), CA2 (a 2-260 of WT, G63D, W123R, E220K), CA2 (aa 2-260 of WT, N11D, E69K, G86D, V109M, K113I, T125I, D138G, G155S), CA2 (aa 2-260 of WT, I59N, G102R, A173T), CA2 (aa 2-260 of WT, L79F, P180S), CA2 (aa 2-260 of WT, A77P, G102R, D138N), CA2 (aa 2-260 of WT, F20L, K45N, G63D, E69V, N231I), CA2 (aa 2-260 of WT, T199N, L202P, L228F), CA2 (aa 2-260 of WT, K9N, H122Y, T168K), CA2 (aa 2-260 of WT, Q53H, L90V, Q92H, G131E), CA2 (aa 2-260 of WT, L44M, L47V, N62K, E69D), CA2 (aa 2-260 of WT, D75V, K169N, F259L), CA2 (aa 2-260 of WT, T207S, V222A, N231D), CA2 (aa 2-260 of WT, I59F, V206M, G232R), CA2 (aa 2-260 of WT, P13A, A133T), CA2 (aa 2-260 of WT, I59N, R89I), CA2 (aa 2-260 of WT, A65N, G86D, G131R, G155D, K158N, V162A, G170D, P236L), CA2 (aa 2-260 of WT, G12R, H15Y, D19V), CA2 (aa 2-260 of WT, A65V, F95Y, E106G, H107Q, I145M, F175I), CA2 (aa 2-260 of WT, G63D, E69V, N231I), CA2 (aa 2-260 of WT, S29A, C205S) and/or CA2 (aa 2-260 of WT, S29C, C205S). As used herein, "X" indicates any amino acid.

In some embodiments, a DD may comprise CA2 (aa 2-260 of WT, R27L, H122Y), CA2 (aa 2-260 of WT, T87I, H122Y), CA2 (aa 2-260 of WT, H122Y, N252D), CA2 (aa 2-260 of WT, D72F, V241F), CA2 (aa 2-260 of WT, V241F, P249L), CA2 (aa 2-260 of WT, D72F, P249L), CA2 (aa 2-260 of WT, D71L, L250R), CA2 (aa 2-260 of WT, D72F, P249F), CA2 (aa 2-260 of WT, T55K, G63N, Q248N), CA2 (aa 2-260 of WT, L156H, A257del, S258del, F259del, K260del), CA2 (aa 2-260 of WT, L156H, S2del, H3del, H4del, W5del), CA2 (aa 2-260 of WT, W4Y, L156H), CA2 (aa 2-260 of WT, L156H, G234del, E235del, P236del), CA2 (aa 2-260 of WT, L156H, F225L), CA2 (aa 2-260 of WT, D70N, D74N, D100N, L156H), (CA2 (aa 2-260 of WT, I59N, G102R), CA2 (aa 2-260 of WT, G63D, E69V, N231I), CA2 (aa 2-260 of WT, R27L, T87I, H122Y, N252D), CA2 (a 2-260 of WT, D72F, V241F, P249L), CA2 (a 2-260 of WT, D71L, T87N, L250R), CA2 (aa 2-260 of WT, L156H, S172C, F178Y, E186D), CA2 (aa 2-260 of WT, A77I, P249F), CA2 (aa 2-260 of WT, E106D, C205S), CA2 (aa 2-260 of WT, C205S, W208S), CA2 (aa 2-260 of WT, S73N, R89Y), CA2 (aa 2-260 of WT, D71K, T192F), CA2 (aa 2-260 of WT, S73N, R89F), CA2 (aa 2-260 of WT, G63D, M240L), CA2 (aa 2-260 of WT, V134F, L228F), and/or CA2 (aa 2-260 of WT, S56F, D71S).

The biocircuit systems described herein may be responsive to one or more stimuli. Such stimuli may be small molecules, such as but not limited to, Acetazolamide, -Celecoxib, Valdecoxib, Rofecoxib, Methazolamide, Dorzolamide, Brinzolamide, Diclofenamide, Ethoxzolamide, Zonisamide, Dansylamide, and Dichlorphenamide. In one embodiment, the small molecule may be Acetazolamide. In one embodiment, the stimulus may be Celecoxib.

In some embodiments, the IL12 may be p40 (SEQ ID NO. 4), appended to a p35 (SEQ ID NO. 1).

In some embodiments, the payload may be the whole or a portion of IL12. In one aspect, the IL12 may include a p40 subunit (SEQ ID NO. 4), appended to a p35 (SEQ ID NO. 1).

In some embodiments, the CA2 biocircuit system may include, in full or a region thereof, an amino acid sequence such as, but not limited to, SEQ ID NO. 5970, SEQ ID NO. 5972, SEQ ID NO. 5974, SEQ ID NO. 5976, and SEQ ID NO. 5978. As a non-limiting example, the CA2 biocircuit system may include, in full or a region thereof, the amino acid sequence of SEQ ID NO. 5970. As a non-limiting example, the CA2 biocircuit system may include, in full or a region thereof, the amino acid sequence of SEQ ID NO. 5972. As a non-limiting example, the CA2 biocircuit system may include, in full or a region thereof, the amino acid sequence of SEQ ID NO. 5974. As a non-limiting example, the CA2 biocircuit system may include, in full or a region thereof, the amino acid sequence of SEQ ID NO. 5976. As a non-limiting example, the CA2 biocircuit system may include, in full or a region thereof, the amino acid sequence of SEQ ID NO. 5978.

Also provided herein are compositions that include CA2 biocircuit systems described herein and a chimeric antigen receptor (CAR). In some embodiments, the chimeric antigen receptor may be operably linked to CA2 biocircuit. In some aspects, the CAR may be a CD19 CAR. In one embodiment, the CAR may be SEQ ID NO. 5980.

Also provided herein are polynucleotides encoding the-SREs, biocircuit systems-end/or compositions described herein as well as vectors comprising the polynucleotides and cells comprising the polynucleotides. The present disclosure also describes-pharmaceutical compositions that include-components of CA2-biocircuit systems and/or the compositions described herein and a pharmaceutically acceptable excipient.

The present disclosure provides suitable examples and embodiments which describes the use of the various compositions, biocircuit systems, and components thereof, to treat a disease in a person in need thereof. For example, a method for treating a disease and/or inducing an immune response in a subject in need thereof, comprises the steps of (a) administering to the subject a therapeutically effective amount of a composition (comprising: an effector module polypeptide, wherein the effector module polypeptide comprises: i) a stimulus response element (SRE), wherein the SRE comprises a drug responsive domain (DRD), said DRD comprising human carbonic anhydrase 2 (CA2; SEQ ID NO. 5810) or a region thereof, and further comprising one or more mutations relative to the amino acid sequence of SEQ ID NO. 5810; and ii) at least one payload which is operably linked to the SRE, wherein the payload comprises IL12 or a portion thereof), or a polynucleotide which encodes the composition components, or a vector that contains such polynucleotides which encode the components of the composition, or a cell which contains such vector, which is able to synthesize the components of the composition described herein; and (b) administering to the subject a therapeutically effective amount of a stimulus, for example, Acetazolamide, Celecoxib, Valdecoxib, Rofecoxib, Methazolamide, Dorzolamide, Brinzolamide, Diclofenamide, Ethoxzolamide, Zonisamide, Dansylamide, or Dichlorphenamide, wherein the SRE is responsive to the stimulus and wherein expression of the at least one payload is modulated in response to the stimulus to thereby treat the disease and/or induce an immune response.

Exemplary diseases that can be treated and/or prevented using the biocircuit systems and engineered cells herein can include: immune diseases, autoimmune diseases, infections diseases and hyperproliferative diseases, for example, cancer.

DETAILED DESCRIPTION

The details of one or more embodiments of the present disclosure are set forth in the accompanying description below. Although any materials and methods similar or equivalent to those described herein can be used in the practice or testing of the present disclosure, the preferred materials and methods are now described. Other features, objects and advantages of the present disclosure will be apparent from the description. In the description, the singular forms also include the plural unless the context clearly dictates otherwise. Unless defined otherwise, all technical and scientific terms used herein have the same meaning as commonly understood by one of ordinary skill in the art to which this present disclosure belongs. In the case of conflict, the present description will control.

I. Compositions

Biocircuits or Biocircuit Systems

According to the present disclosure, biocircuit systems are provided which comprise, at their core, at least one effector module. Such effector module(s) are independently having associated, or integral therewith, one or more stimulus response elements (SREs). In general, a stimulus response element (SRE) may be operably linked to a payload which could be any protein of interest (POI) (e.g., an immunotherapeutic agent), to form an effector module. The SRE, when activated by a particular stimulus, e.g., a small molecule, can produce a signal or outcome, to regulate transcription and/or protein levels of the linked payload either up or down by perpetuating a stabilizing signal or destabilizing signal, or any other types of regulation. A much-detailed description of a biocircuit system are taught in co-owned U.S. Provisional Patent Application No. 62/320,864 filed Apr. 11, 2016, 62/466,596 filed Mar. 3, 2017 and the International Publication WO2017/180587 (the contents each of which are herein incorporated by reference in their entirety). In accordance with the present disclosure, biocircuit systems, effector modules, SREs and components that tune expression levels and activities of any agents used for immunotherapy are provided.

As used herein, a "biocircuit" or "biocircuit system" is defined as a circuit within or useful in biologic systems comprising a stimulus and at least one effector module responsive to a stimulus, where the response to the stimulus produces at least one signal or outcome within, between, as an indicator of, or on a biologic system. Biologic systems are generally understood to be any cell, tissue, organ, organ system or organism, whether animal, plant, fungi, bacterial, or viral. It is also understood that biocircuits may be artificial circuits which employ the stimuli or effector modules taught by the present disclosure and effect signals or outcomes in acellular environments such as with diagnostic, reporter systems, devices, assays or kits. The artificial circuits may be associated with one or more electronic, magnetic, or radioactive components or parts.

Effector Modules

The biocircuits of the disclosure include at least one effector module. As used herein, an "effector module" is a single or multi-component construct or complex comprising at least (a) one or more stimulus response elements (SREs) and (b) one or more payloads (e.g. proteins of interest (POIs)).

Effector modules may be designed to include one or more payloads, one or more SREs, one or more cleavage sites, one or more signal sequences and one or more additional features including the presence or absence of one or more linkers. Representative effector module embodiments of the present disclosure are illustrated in FIGS. 2-6 in International Publication No. WO2017/180587, the contents of which are herein incorporated by reference in their entirety. Biocircuits and components utilizing such effector molecules are given in FIGS. 7-12 in International Publication No. WO2017/180587, the contents of which are herein incorporated by reference in their entirety.

As shown in FIG. 2 in International Publication No. WO2017/180587, representative effector module embodiments comprising one payload, i.e. one immunotherapeutic agent are illustrated. Each component of the effector module may be located or positioned in various arrangements without (A to F) or with (G to Z, and AA to DD) a cleavage site. An optional linker may be inserted between each component of the effector module.

FIGS. 3 to 6 in International Publication No. WO2017/180587, illustrate representative effector module embodiments comprising two payloads, i.e. two immunotherapeutic agents. In some aspects, more than two immunotherapeutic agents (payloads) may be included in the effector module under the regulation of the same SRE (e.g., the same DD). The two or more agents may be either directly linked to each other or separated. The SRE may be positioned at the N terminus of the construct, or the C terminus of the construct, or in the internal location.

The combination of the T regulatory cells, myeloid derived suppressor cells (MDSCs) and the extensive stromal networks within the tumor microenvironment (TME) can dampen the antitumor immune response by preventing T-cell infiltration and/or activation by current immunotherapies (see Ma et al. *A CD40 agonist and PD-1 antagonist antibody*

*reprogram the microenvironment of non-immunogenic tumors to allow T cell-mediated anticancer activity*. Cancer Immunol Res Jan. 14, 2019; doi: 10.1158/2326-606.CIR-18-0061; the contents of which are herein incorporated by reference in their entireties). Current CAR T therapies are not effective as the therapeutics have immunosuppression, tumor antigen escape, insufficient CAR T expansion and healthy tissue toxicity. The present disclosure addresses these issues with the utilization of an effector module with mbIL12 as an immunotherapeutic agent, operably linked to an SRE described herein. The mbIL12 may not be the only immunotherapeutic agent in the effector module. The effector module may also include a CAR construct.

In some embodiments, biocircuits of the present disclosure may be modified to reduce their immunogenicity. Immunogenicity is the result of a complex series of responses to a substance that is perceived as foreign and may include the production of neutralizing and non-neutralizing antibodies, formation of immune complexes, complement activation, mast cell activation, inflammation, hypersensitivity responses, and anaphylaxis. Several factors can contribute to protein immunogenicity, including, but not limited to protein sequence, route and frequency of administration and patient population. In a preferred embodiment, protein engineering may be used to reduce the immunogenicity of the compositions of the disclosure. In some embodiments, modifications to reduce immunogenicity may include modifications that reduce binding of the processed peptides derived from the parent sequence to MHC proteins. For example, amino acid modifications may be engineered such that there are no or a minimal of number of immune epitopes that are predicted to bind with high affinity, to any prevalent MHC alleles. Several methods of identifying MHC binding epitopes of known protein sequences are known in the art and may be used to score epitopes in the compositions of the present disclosure. Such methods are disclosed in US Patent Publication No. US 20020119492, US20040230380, and US 20060148009; the contents of each of which are incorporated by reference in their entirety.

Effector modules, including their SREs and payloads, may be nucleic acid-based, protein-based or a combination thereof. They may be in the form of DNA, RNA, mRNA, proteins, fusion proteins, or any combination of the foregoing.

Stimulus Response Element (SRE)

As used herein a "stimulus response element" (SRE) is a component of an effector module which is joined, attached, linked to or associated with one or more payloads and in some instances, is responsible for the responsive nature of the effector module to one or more stimuli. As used herein, the "responsive" nature of an SRE to a stimulus may be characterized by a covalent or non-covalent interaction, a direct or indirect association or a structural or chemical reaction to the stimulus. Further, the response of any SRE to a stimulus may be a matter of degree or kind. The response may be a partial response. The response may be a reversible response. The response may ultimately lead to a regulated signal or output. Such output signal may be of a relative nature to the stimulus, e.g., producing a modulatory effect of between 1% and 100% or a factored increase or decrease such as 2-fold, 3-fold, 4-fold, 5-fold, 10-fold or more. In some embodiments, the SRE is a polypeptide fused to a polypeptide payload, for example, mbIL12.

In some embodiments, the present disclosure provides methods for modulating protein expression, function or level. In some aspects, the modulation of protein expression, function or level refers to modulation of expression, function or level by at least about 20%, such as by at least about 30%, 40%, 50%, 60%, 70%, 80%, 85%, 90%, 95% and 100%, or at least 20-30%, 20-40%, 20-50%, 20-60%, 20-70%, 20-80%, 20-90%, 20-95%, 20-100%, 30-40%, 30-50%, 30-60%, 30-70%, 30-80%, 30-90%, 30-95%, 30-100%, 40-50%, 40-60%, 40-70%, 40-80%, 40-90%, 40-95%, 40-100%, 50-60%, 50-70%, 50-80%, 50-90%, 50-95%, 50-100%, 60-70%, 60-80%, 60-90%, 60-95%, 60-100%, 70-80%, 70-90%, 70-95%, 70-100%, 80-90%, 80-95%, 80-100%, 90-95%, 90-100% or 95-100%.

Effector modules, including their SREs and payloads may individually, collectively or independently comprise peptides, polypeptides or proteins. At the protein level, such payload may be any natural or artificial peptide or polypeptide or fragment thereof. Natural peptides or polypeptide components of the payload may be derived from any known protein of any species.

Effector modules may be designed to operate in groups of one, two, three, four or more modules. When more than one effector module is utilized in a biocircuit, it is known as an effector module system of that biocircuit.

Destabilizing Domains

Destabilizing domains (DDs) are small protein domains that can be appended to a target protein of interest. The term destabilizing domain (DD) is interchangeable with the term drug responsive domain (DRD). -DDs render the attached protein of interest unstable in the absence of a DD-binding ligand such that the protein is rapidly degraded by the ubiquitin-proteasome system of the cell (Stankunas, K., et al., *Mol. Cell,* 2003, 12: 1615-1624; Banaszynski, et al., *Cell;* 2006, 126(5): 995-1004; reviewed in Banaszynski, L. A., and Wandless, T. J. *Chem. Biol.;* 2006, 13:11-21 and Rakhit R et al., *Chem Biol.* 2014; 21(9):1238-1252). However, when a specific small molecule ligand binds its intended DD as a ligand binding partner, the instability is reversed, and protein function is restored. The conditional nature of DD stability allows a rapid and non-perturbing switch from stable protein to unstable substrate for degradation. Moreover, its dependency on the concentration of its ligand further provides tunable control of degradation rates.

In one embodiment, the SRE is a destabilizing domain (DD). The presence, absence or an amount of a small molecule ligand that binds to or interacts with the DD, can, upon such binding or interaction modulate the stability of the payload(s) and consequently the function of the payload. Depending on the degree of binding and/or interaction the altered function of the payload may vary, hence providing a "tuning" of the payload function.

In some embodiments, the desired characteristics of the DDs may include, but are not limited to, low protein levels in the absence of a ligand of the DD (e.g., low basal stability), large dynamic range, robust and predictable dose-response behavior, and rapid kinetics of degradation. DDs that bind to a desired ligand, but not endogenous molecules may be preferred.

In some embodiments, the DDs of the present disclosure may be developed from known proteins herein referred to as the parent protein. In some embodiments, the CA2 destabilizing domains described herein or known in the art may be used as SREs in the biocircuit systems of the present disclosure in association with any of the payloads (e.g., proteins of interest or immunotherapeutic agents) taught herein.

Regions or portions or domains of wild type proteins (e.g., CA2) may be utilized as SREs/DDs in whole or in part. They may be combined or rearranged to create new peptides, proteins, regions or domains of which any may be used as SREs/DDs or the starting point for the design of further SREs and/or DDs.

In one embodiment, the SRE is derived from a region of a parent protein (e.g., CA2) or from a mutant protein. The region of the parent protein may be 5-50, 25-75, 50-100, 75-125, 100-150, 125-175, 150-200, 175-225, 200-250, 225-275, 250-300, 275-325, 300-350, 325-375, 350400, 375425, or 400-450 amino acids in length. As a non-limiting example, the region of the parent protein may be 250-270 amino acids in length. As a non-limiting example, the region of the parent protein may be 225-250 amino acids in length. As a non-limiting example, the region of the parent protein may be 225-260 amino acids in length.

In one embodiment, the SRE is derived from a parent protein (e.g., CA2) or from a mutant protein and includes a region of the parent protein. The SRE may include a region of the parent protein which is 1%, 5%, 10%, 15%, 20%, 25%, 30%, 35%, 40%, 45%, 50%, 55%, 60%, 65%, 70%, 75%, 80%, 85%, 90%, 95%, 99%, or 100%, 5-10%, 10-15%, 15-20%, 20-25%, 25-30%, 30-35%, 35-40%, 40-45%, 45-50%, 50-55%, 55-60%, 60-65%, 65-70%, 70-75%, 75-80%, 80-85%, 85-90%, 90-95%, 95-100%, 10-20%, 20-30%, 30-40%, 40-50%, 50-60%, 60-70%, 70-80%, 80-90%, 90-100%, 10-30%, 20-40%, 30-50%, 40-60%, 50-70%, 60-80%, 70-90%, 80-100%, 10-40%, 20-50%, 30-60%, 40-70%, 50-80%, 60-90%, 70-100%, 10-50%, 20-60%, 30-70%, 40-80%, 50-90%, 60-100%, 10-60%, 20-70%, 30-80%, 40-90%, 50-100%, 10-70%, 20-80%, 30-90%, 40-100%, 10-80%, 20-90%, 30-100%, 10-90%, 20-100%, 25-50%, 50-75%, or 75-100% of the parent protein or mutant protein.

In one embodiment, the SRE is derived from a parent protein (e.g., CA2) or from a mutant protein and may have 1%, 5%, 10%, 15%, 20%, 25%, 30%, 35%, 40%, 45%, 50%, 55%, 60%, 65%, 70%, 75%, 80%, 85%, 90%, 95%, 99%, or 100%, 5-10%, 10-15%, 15-20%, 20-25%, 25-30%, 30-35%, 35-40%, 40-45%, 45-50%, 50-55%, 55-60%, 60-65%, 65-70%, 70-75%, 75-80%, 80-85%, 85-90%, 90-95%, 95-100%, 10-20%, 20-30%, 30-40%, 40-50%, 50-60%, 60-70%, 70-80%, 80-90%, 90-100%, 10-30%, 20-40%, 30-50%, 40-60%, 50-70%, 60-80%, 70-90%, 80-100%, 10-40%, 20-50%, 30-60%, 40-70%, 50-80%, 60-90%, 70-100%, 10-50%, 20-60%, 30-70%, 40-80%, 50-90%, 60-100%, 10-60%, 20-70%, 30-80%, 40-90%, 50-100%, 10-70%, 20-80%, 30-90%, 40-100%, 10-80%, 20-90%, 30-100%, 10-90%, 20-100%, 25-50%, 50-75%, or 75-100% identity to the parent protein or mutant protein.

Candidate destabilizing domain sequence identified from protein domains of parent proteins (as a template) may be mutated to generate libraries of mutants based on the template candidate domain sequence. Mutagenesis strategies used to generate DD libraries may include site-directed mutagenesis e.g. by using structure guided information; or random mutagenesis e.g. using error-prone PCR, or a combination of both. In some embodiments, destabilizing domains identified using random mutagenesis may be used to identify structural properties of the candidate DDs that may be required for destabilization, which may then be used to further generate libraries of mutations using site directed mutagenesis.

In some embodiments, DD mutant libraries may be screened for mutations with altered, preferably higher binding affinity to the ligand, as compared to the wild type protein. DD libraries may also be screened using two or more ligands and DD mutations that are stabilized by some ligands but not others may be preferentially selected. DD mutations that bind preferentially to the ligand compared to a naturally occurring protein may also be selected. Such methods may be used to optimize ligand selection and ligand binding affinity of the DD. Additionally, such approaches can be used to minimize deleterious effects caused by off-target ligand binding.

In some embodiments, suitable DDs may be identified by screening mutant libraries using barcodes. Such methods may be used to detect, identify and quantify individual mutant clones within the heterogeneous mutant library. Each DD mutant within the library may have distinct barcode sequences (with respect to each other). In other instances, the polynucleotides can also have different barcode sequences with respect to 2, 3, 4, 5, 6, 7, 8, 9, 10 or more nucleic acid bases. Each DD mutant within the library may also comprise a plurality of barcode sequences. When used in plurality may be used such that each barcode is unique to any other barcode. Alternatively, each barcode used may not be unique, but the combination of barcodes used may create a unique sequence that can be individually tracked. The barcode sequence may be placed upstream of the SRE, downstream of the SRE, or in some instances may be placed within the SRE. DD mutants may be identified by barcodes using sequencing approaches such as Sanger sequencing, and next generation sequencing, but also by polymerase chain reaction and quantitative polymerase chain reaction. In some embodiments, polymerase chain reaction primers that amplify a different size product for each barcode may be used to identify each barcode on an agarose gel. In other instances, each barcode may have a unique quantitative polymerase chain reaction probe sequence that enables targeted amplification of each barcode.

In one embodiment, the effector modules and/or SREs of the present disclosure may include at least one destabilizing domain (DD). The effector modules and/or SRE may include 1, 2, 3, 4, 5, 6, 7, 8, 9, 10 or more than 10 DDs. When there are more than one DDs, each of the DDs may be derived from the same parent protein, from different parent proteins, may be a fusion of two different parent proteins, or may be artificial.

In one embodiment, the effector modules and/or SREs of the present disclosure may include 2 DDs. In one embodiment, the effector modules and/or SREs of the present disclosure may include 3 DDs. In one embodiment, the effector modules and/or SREs of the present disclosure may include 4 DDs. In one embodiment, the effector modules and/or SREs of the present disclosure may include 5 DDs. In one embodiment, the effector modules and/or SREs of the present disclosure may include 6 DDs. In one embodiment, the effector modules and/or SREs of the present disclosure may include 7 DDs. In one embodiment, the effector modules and/or SREs of the present disclosure may include 8 DDs. In one embodiment, the effector modules and/or SREs of the present disclosure may include 9 DDs. In one embodiment, the effector modules and/or SREs of the present disclosure may include 10 DDs. The DDs may be derived from any parent protein known in the art and/or described herein. In some embodiments the DDs are derived from the same parent protein. In some embodiments the DDs are derived from different regions of the same parent protein. In some embodiments, the DDs are derived from different parent proteins.

CA2 Destabilizing Domains

In some embodiments, the DDs of the present disclosure may be derived from human carbonic anhydrase 2 CA2, which is a member of the Carbonic anhydrases (CAs, EC 4.2.1.1) a superfamily of metalloenzymes present in all life kingdoms. CAs equilibrate the reaction between three chemical species: CO2, bicarbonate, and protons. CAs have convergently evolved, with seven genetically distinct CA families that evolved independently in Bacteria, Archaea, and Eukarya, the $\alpha$-, $\beta$-, $\gamma$-, $\delta$-, $\zeta$-, $\eta$-, and $\theta$-CAs. In some embodiments, the DDs described herein may be derived from at least one parent protein selected from, but not limited to Carbonic Anhydrase 2 (CA2), Carbonic Anhydrase 1 (CA1), Carbonic Anhydrase 3 (CA3), Carbonic Anhydrase 4 (CA4), Carbonic Anhydrase 5A (CA5A), Carbonic Anhydrase 5B (CA5B), Carbonic Anhydrase 6 (CA6), Carbonic Anhydrase 7 (CA7), Carbonic Anhydrase 8 (CA8), Carbonic Anhydrase 9 (CA9), Carbonic Anhydrase 10 (CA10), Carbonic Anhydrase 11 (CA11), Carbonic Anhydrase 12 (CA12), Carbonic Anhydrase 13 (CA13), and Carbonic Anhydrase 14 (CA14).

In one embodiment, the DDs may be derived from cytosolic CAs such as but not limited to Carbonic Anhydrase 2 (CA2), Carbonic Anhydrase 1 (CA1), Carbonic Anhydrase 3 (CA3), Carbonic Anhydrase 7 (CA7), and Carbonic Anhydrase 13 (CA13). In one embodiment, the DDs may be derived from mitochondrial CAs such as but not limited to Carbonic Anhydrase 5A (CA5A), and Carbonic Anhydrase 5B (CA5B). In one embodiment, the DDs may be derived from secreted CAs such as but not limited to Carbonic Anhydrase 6 (CA6). In one embodiment, the DDs may be derived from membrane associated CAs such as but not limited to Carbonic Anhydrase 4 (CA4), Carbonic Anhydrase 9 (CA9), Carbonic Anhydrase 12 (CA12), and Carbonic Anhydrase 14 (CA14). In one embodiment, the DD is derived from CA2. In another aspect, the DD may be derived from CA9.

In some embodiments, the DDs of the present disclosure may be derived from CA2 (SEQ ID NO. 5810; Uniprot ID: P00918) which may be stabilized by ligands such as small molecule inhibitors of CA2. As used herein the term "CA2 WT", refers to the human wildtype CA2 protein sequence, which is defined as SEQ ID NO. 5810, with the GenBank Access NO. P00918, having the amino acid sequence:

```
MSHHWGYGKHNGPEHWHKDFPIAKGERQSPVDIDTHTAKYDPSLKPLSV

SYDQATSLRILNNGHAFNVEFDDSQDKAVLKGGPLDGTYRLIQFHFHWG

SLDGQGSEHTVDKKKYAAELHLVHWNTKYGDFGKAVQQPDGLAVLGIFL

KVGSAKPGLQKVVDVLDSIKTKGKSADFTNFDPRGLLPESLDYWTYPGS

LTTPPLLECVTWIVLKEPISVSSEQVLKFRKLNFNGEGEPEELMVDNWR

PAQPLKNRQIKASFK.
```

In some embodiments, DDs of the present disclosure may be identified by utilizing a cocktail of CA2 inhibitors. In other instances, the suitable DDs may be identified by screening first with one CA2 inhibitor and subsequently screening with a second CA2 inhibitor.

The amino acid sequences of the destabilizing domains encompassed in the disclosure have at least about 40%, 50 or 60% identity, further at least about 70% identity, preferably at least about 75% or 80% identity, more preferably at least about 85%, 86%, 87%, 88%, 89% or 90% identity, and further preferably at least about 91%, 92%, 93%, 94%, 95%, %%, 97%, 98% or 99% identity to the amino acid sequence set forth therein. Percent identity may be determined, for example, by comparing sequence information using the advanced BLAST computer program, including version Magic-BLAST 1.2.0, available from the National Institutes of Health. The BLAST program is based on the alignment method discussed in Karl and Altschul (1990) Proc. Nat. Acad. Sci USA, 87:2264-68 (the contents of which are incorporated by reference in their entirety).

In some embodiments, DDs derived from CA2 may comprise amino acids 2-260 of the parent CA2 sequence. This is referred to herein as an M1del mutation. In one embodiment, DDs derived from CA2 may comprise amino acids 2-237 of the parent CA2 sequence.

Provided herein in Table 1, Table 2, Table 3, Table 4 and Table 6 are CA2 mutants identified by mutagenesis such as random mutagenesis screening, using a combination of nucleotide analog mutagenesis and error-prone PCR, to generate libraries of mutants; or saturation mutagenesis. CA2 destabilizing mutants may also be identified by structure guided mutagenesis and are provided in Table 1. The position of the mutated amino acids listed in Table 1, Table 2, Table 3, Table 4, Table 5, and Table 6 are relative to the full length CA2 of SEQ ID NO. 5810.

TABLE 1

CA2 DDs

| Library ID | Description | AA SEQUENCE | AA SEQ ID NO. | NA SEQ ID NO. |
|---|---|---|---|---|
| — | CA2 (aa 2-260 of WT) | SHHWGYGKHNGPEHWHKDFPIAKGERQSPVDIDTHTAKYDPSLKPLSVSYD QATSLRILNNGHAFNVEFDDSQDKAVLKGGPLDGTYRLIQFHFHWGSLDGQ GSEHTVDKKKYAAELHLVHWNTKYGDFGKAVQQPDGLAVLGIFLKVGSAK PGLQKVVDVLDSIKTKGKSADFTNFDPRGLLPESLDYWTYPGSLTTPPLLEC VTWIVLKEPISVSSEQVLKFRKLNFNGEGEPEELMVDNWRPAQPLKNRQIKA SFK | 5651 | 5652 |
| — | CA2 (aa 2-260 of WT, W208S) | SHHWGYGKHNGPEHWHKDFPIAKGERQSPVDIDTHTAKYDPSLKPLSVSYD QATSLRILNNGHAFNVEFDDSQDKAVLKGGPLDGTYRLIQFHFHWGSLDGQ GSEHTVDKKKYAAELHLVHWNTKYGDFGKAVQQPDGLAVLGIFLKVGSAK PGLQKVVDVLDSIKTKGKSADFTNFDPRGLLPESLDYWTYPGSLTTPPLLEC VTSIVLKEPISVSSEQVLKFRKLNFNGEGEPEELMVDNWRPAQPLKNRQIKA SFK | 5653 | 5654 |
| LibC000103 | CA2 (aa 2-260 of WT, Y51N) | SHHWGYGKHNGPEHWHKDFPIAKGERQSPVDIDTHTAKYDPSLKPLSVSND QATSLRILNNGHAFNVEFDDSQDKAVLKGGPLDGTYRLIQFHFHWGSLDGQ GSEHTVDKKKYAAELHLVHWNTKYGDFGKAVQQPDGLAVLGIFLKVGSAK PGLQKVVDVLDSIKTKGKSADFTNFDPRGLLPESLDYWTYPGSLTTPPLLEC VTWIVLKEPISVSSEQVLKFRKLNFNGEGEPEELMVDNWRPAQPLKNRQIKA SFK | 5655 | 5656 |
| LibC000101 | CA2 (aa 2-260 of WT, S56N) | SHHWGYGKHNGPEHWHKDFPIAKGERQSPVDIDTHTAKYDPSLKPLSVSYD QATNLRILNNGHAFNVEFDDSQDKAVLKGGPLDGTYRLIQFHFHWGSLDGQ GSEHTVDKKKYAAELHLVHWNTKYGDFGKAVQQPDGLAVLGIFLKVGSAK PGLQKVVDVLDSIKTKGKSADFTNFDPRGLLPESLDYWTYPGSLTTPPLLEC VTWIVLKEPISVSSEQVLKFRKLNFNGEGEPEELMVDNWRPAQPLKNRQIKA SFK | 5657 | 5658 |
| LibC000098 LibC000097 | CA2 (aa 2-260 of WT, Y51T) | SHHWGYGKHNGPEHWHKDFPIAKGERQSPVDIDTHTAKYDPSLKPLSVSTD QATSLRILNNGHAFNVEFDDSQDKAVLKGGPLDGTYRLIQFHFHWGSLDGQ GSEHTVDKKKYAAELHLVHWNTKYGDFGKAVQQPDGLAVLGIFLKVGSAK PGLQKVVDVLDSIKTKGKSADFTNFDPRGLLPESLDYWTYPGSLTTPPLLEC VTWIVLKEPISVSSEQVLKFRKLNFNGEGEPEELMVDNWRPAQPLKNRQIKA SFK | 5659 | 5660 5661 |
| LibC000095 | CA2 (aa 2-260 of WT, D72F, V241F, P249L) | SHHWGYGKHNGPEHWHKDFPIAKGERQSPVDIDTHTAKYDPSLKPLSVSYD QATSLRILNNGHAFNVEFDFSQDKAVLKGGPLDGTYRLIQFHFHWGSLDGQ GSEHTVDKKKYAAELHLVHWNTKYGDFGKAVQQPDGLAVLGIFLKVGSAK PGLQKVVDVLDSIKTKGKSADFTNFDPRGLLPESLDYWTYPGSLTTPPLLEC VTWIVLKEPISVSSEQVLKFRKLNFNGEGEPEELMFDNWRPAQLLKNRQIKA SFK | 5662 | 5663 |
| LibC000084 | CA2 (aa 2-260 of WT, D71F, N231F) | SHHWGYGKHNGPEHWHKDFPIAKGERQSPVDIDTHTAKYDPSLKPLSVSYD QATSLRILNNGHAFNVEFFDSQDKAVLKGGPLDGTYRLIQFHFHWGSLDGQ GSEHTVDKKKYAAELHLVHWNTKYGDFGKAVQQPDGLAVLGIFLKVGSAK PGLQKVVDVLDSIKTKGKSADFTNFDPRGLLPESLDYWTYPGSLTTPPLLEC VTWIVLKEPISVSSEQVLKFRKLNFFGEGEPEELMVDNWRPAQPLKNRQIKA SFK | 5664 | 5665 |
| LibC000079 LibC000078 | CA2 (aa 2-260 of WT, S56F) | SHHWGYGKHNGPEHWHKDFPIAKGERQSPVDIDTHTAKYDPSLKPLSVSYD QATFLRILNNGHAFNVEFDDSQDKAVLKGGPLDGTYRLIQFHFHWGSLDGQ GSEHTVDKKKYAAELHLVHWNTKYGDFGKAVQQPDGLAVLGIFLKVGSAK PGLQKVVDVLDSIKTKGKSADFTNFDPRGLLPESLDYWTYPGSLTTPPLLEC VTWIVLKEPISVSSEQVLKFRKLNFNGEGEPEELMVDNWRPAQPLKNRQIKA SFK | 5666 | 5667 5668 |
| LibC000073 | CA2 (aa 2-260 of WT, D71L, T87N, L250R) | SHHWGYGKHNGPEHWHKDFPIAKGERQSPVDIDTHTAKYDPSLKPLSVSYD QATSLRILNNGHAFNVEFLDSQDKAVLKGGPLDGNYRLIQFHFHWGSLDGQ GSEHTVDKKKYAAELHLVHWNTKYGDFGKAVQQPDGLAVLGIFLKVGSAK PGLQKVVDVLDSIKTKGKSADFTNFDPRGLLPESLDYWTYPGSLTTPPLLEC VTWIVLKEPISVSSEQVLKFRKLNFNGEGEPEELMVDNWRPAQPRKNRQIKA SFK | 5669 | 5670 |

TABLE 1-continued

CA2 DDs

| Library ID | Description | AA SEQUENCE | AA SEQ ID NO. | NA SEQ ID NO. |
|---|---|---|---|---|
| LibC000090 | CA2 (aa 2-260 of WT, L183S) | SHHWGYGKHNGPEHWHKDFPIAKGERQSPVDIDTHTAKYDPSLKPLSVSYD QATSLRILNNGHAFNVEFDDSQDKAVLKGGPLDGTYRLIQFHFHWGSLDGQ GSEHTVDKKKYAAELHLVHWNTKYGDFGKAVQQPDGLAVLGIFLKVGSAK PGLQKVVDVLDSIKTKGKSADFTNFDPRGSLPESLDYWTYPGSLTTPPLLEC VTWIVLKEPISVSSEQVLKFRKLNFNGEGEPEELMVDNWRPAQPLKNRQIKA SFK | 5671 | 5672 |
| LibC000076 | CA2 (aa 2-260 of WT, A77I, P249F) | SHHWGYGKHNGPEHWHKDFPIAKGERQSPVDIDTHTAKYDPSLKPLSVSYD QATSLRILNNGHAFNVEFDDSQDKIVLKGGPLDGTYRLIQFHFHWGSLDGQ GSEHTVDKKKYAAELHLVHWNTKYGDFGKAVQQPDGLAVLGIFLKVGSAK PGLQKVVDVLDSIKTKGKSADFTNFDPRGLLPESLDYWTYPGSLTTPPLLEC VTWIVLKEPISVSSEQVLKFRKLNFNGEGEPEELMVDNWRPAQPLKNRQIKA SFK | 5673 | 5674 |
| LibC000099 | CA2 (aa 2-260 of WT, D71K, P249H) | SHHWGYGKHNGPEHWHKDFPIAKGERQSPVDIDTHTAKYDPSLKPLSVSYD QATSLRILNNGHAFNVEFKDSQDKAVLKGGPLDGTYRLIQFHFHWGSLDGQ GSEHTVDKKKYAAELHLVHWNTKYGDFGKAVQQPDGLAVLGIFLKVGSAK PGLQKVVDVLDSIKTKGKSADFTNFDPRGLLPESLDYWTYPGSLTTPPLLEC VTWIVLKEPISVSSEQVLKFRKLNFNGEGEPEELMVDNWRPAQHLKNRQIK ASFK | 5675 | 5676 |
| LibC000081 LibC000065 | CA2 (aa 2-260 of WT, D72F, P249H) | SHHWGYGKHNGPEHWHKDFPIAKGERQSPVDIDTHTAKYDPSLKPLSVSYD QATSLRILNNGHAFNVEFDFSQDKAVLKGGPLDGTYRLIQFHFHWGSLDGQ GSEHTVDKKKYAAELHLVHWNTKYGDFGKAVQQPDGLAVLGIFLKVGSAK PGLQKVVDVLDSIKTKGKSADFTNFDPRGLLPESLDYWTYPGSLTTPPLLEC VTWIVLKEPISVSSEQVLKFRKLNFNGEGEPEELMVDNWRPAQFLKNRQIKA SFK | 5677 | 5678 5679 |
| LibC000082 | CA2 (aa 2-260 of WT, Q53N, N61Y) | SHHWGYGKHNGPEHWHKDFPIAKGERQSPVDIDTHTAKYDPSLKPLSVSYD NATSLRILYNGHAFNVEFDDSQDKAVLKGGPLDGTYRLIQFHFHWGSLDGQ GSEHTVDKKKYAAELHLVHWNTKYGDFGKAVQQPDGLAVLGIFLKVGSAK PGLQKVVDVLDSIKTKGKSADFTNFDPRGLLPESLDYWTYPGSLTTPPLLEC VTWIVLKEPISVSSEQVLKFRKLNFNGEGEPEELMVDNWRPAQPLKNRQIKA SFK | 5680 | 5681 |
| — | CA2 (aa 2-260 of WT, E106D, C205S) | SHHWGYGKHNGPEHWHKDFPIAKGERQSPVDIDTHTAKYDPSLKPLSVSYD QATSLRILNNGHAFNVEFDDSQDKAVLKGGPLDGTYRLIQFHFHWGSLDGQ GSDHTVDKKKYAAELHLVHWNTKYGDFGKAVQQPDGLAVLGIFLKVGSA KPGLQKVVDVLDSIKTKGKSADFTNFDPRGLLPESLDYWTYPGSLTTPPLLE SVTWIVLKEPISVSSEQVLKFRKLNFNGEGEPEELMVDNWRPAQPLKNRQIK ASFK | 5682 | 5683 |
| — | CA2 (aa 2-260 of WT, C205S, W2085) | SHHWGYGKHNGPEHWHKDFPIAKGERQSPVDIDTHTAKYDPSLKPLSVSYD QATSLRILNNGHAFNVEFDDSQDKAVLKGGPLDGTYRLIQFHFHWGSLDGQ GSEHTVDKKKYAAELHLVHWNTKYGDFGKAVQQPDGLAVLGIFLKVGSAK PGLQKVVDVLDSIKTKGKSADFTNFDPRGLLPESLDYWTYPGSLTTPPLLES VTSIVLKEPISVSSEQVLKFRKLNFNGEGEPEELMVDNWRPAQPLKNRQIKA SFK | 5684 | 5685 |
| — | CA2 (aa 2-260 of WT, C205S) | SHHWGYGKHNGPEHWHKDFPIAKGERQSPVDIDTHTAKYDPSLKPLSVSYD QATSLRILNNGHAFNVEFDDSQDKAVLKGGPLDGTYRLIQFHFHWGSLDGQ GSEHTVDKKKYAAELHLVHWNTKYGDFGKAVQQPDGLAVLGIFLKVGSAK PGLQKVVDVLDSIKTKGKSADFTNFDPRGLLPESLDYWTYPGSLTTPPLLES VTWIVLKEPISVSSEQVLKFRKLNFNGEGEPEELMVDNWRPAQPLKNRQIKA SFK | 5686 | 5687 |
| LibC000066 LibC000069 | CA2 (aa 2-260 of WT, Y193I) | SHHWGYGKHNGPEHWHKDFPIAKGERQSPVDIDTHTAKYDPSLKPLSVSYD QATSLRILNNGHAFNVEFDDSQDKAVLKGGPLDGTYRLIQFHFHWGSLDGQ GSEHTVDKKKYAAELHLVHWNTKYGDFGKAVQQPDGLAVLGIFLKVGSAK PGLQKVVDVLDSIKTKGKSADFTNFDPRGLLPESLDYWTIPGSLTTPPLLECV TWIVLKEPISVSSEQVLKFRKLNFNGEGEPEELMVDNWRPAQPLKNRQIKAS FK | 5688 | 5689 5690 |
| LibC000056 | CA2 (aa 2-260 of WT, S73N, R89Y) | SHHWGYGKHNGPEHWHKDFPIAKGERQSPVDIDTHTAKYDPSLKPLSVSYD QATSLRILNNGHAFNVEFDDNQDKAVLKGGPLDGTYYLIQFHFHWGSLDGQ GSEHTVDKKKYAAELHLVHWNTKYGDFGKAVQQPDGLAVLGIFLKVGSAK PGLQKVVDVLDSIKTKGKSADFTNFDPRGLLPESLDYWTYPGSLTTPPLLEC VTWIVLKEPISVSSEQVLKFRKLNFNGEGEPEELMVDNWRPAQPLKNRQIKA SFK | 5691 | 5692 |
| LibC000057 | CA2 (aa 2-260 of WT, D71K, T192F) | SHHWGYGKHNGPEHWHKDFPIAKGERQSPVDIDTHTAKYDPSLKPLSVSYD QATSLRILNNGHAFNVEFKDSQDKAVLKGGPLDGTYRLIQFHFHWGSLDGQ GSEHTVDKKKYAAELHLVHWNTKYGDFGKAVQQPDGLAVLGIFLKVGSAK | 5693 | 5694 |

TABLE 1-continued

| | | | | |
|---|---|---|---|---|
| | | CA2 DDs | | |
| Library ID | Description | AA SEQUENCE | AA SEQ ID NO. | NA SEQ ID NO. |
| | | PGLQKVVDVLDSIKTKGKSADFTNFDPRGLLPESLDYWFYPGSLTTPPLLEC VTWIVLKEPISVSSEQVLKFRKLNFNGEGEPEELMVDNWRPAQPLKNRQIKA SFK | | |
| LibC000061 | CA2 (aa 2-260 of WT, E238*) | SHHWGYGKHNGPEHWHKDFPIAKGERQSPVDIDTHTAKYDPSLKPLSVSYD QATSLRILNNGHAFNVEFDDSQDKAVLKGGPLDGTYRLIQFHFHWGSLDGQ GSEHTVDKKKYAAELHLVHWNTKYGDFGKAVQQPDGLAVLGIFLKVGSAK PGLQKVVDVLDSIKTKGKSADFTNFDPRGLLPESLDYWTYPGSLTTPPLLEC VTWIVLKEPISVSSEQVLKFRKLNFNGEGEPE*LMVDNWRPAQPLKNRQIKA SFK | 5695; 5811 | 5696 |
| LibC000061 | CA2 (aa 2-260 of WT, G144D) | SHHWGYGKHNGPEHWHKDFPIAKGERQSPVDIDTHTAKYDPSLKPLSVSYD QATSLRILNNGHAFNVEFDDSQDKAVLKGGPLDGTYRLIQFHFHWGSLDGQ GSEHTVDKKKYAAELHLVHWNTKYGDFGKAVQQPDGLAVLDIFLKVGSAK PGLQKVVDVLDSIKTKGKSADFTNFDPRGLLPESLDYWTYPGSLTTPPLLEC VTWIVLKEPISVSSEQVLKFRKLNFNGEGEPEELMVDNWRPAQPLKNRQIKA SFK | 5697 | 5698 |
| LibC000092 | CA2 (aa 2-260 of WT, Y193L, K260L) | SHHWGYGKHNGPEHWHKDFPIAKGERQSPVDIDTHTAKYDPSLKPLSVSYD QATSLRILNNGHAFNVEFDDSQDKAVLKGGPLDGTYRLIQFHFHWGSLDGQ GSEHTVDKKKYAAELHLVHWNTKYGDFGKAVQQPDGLAVLGIFLKVGSAK PGLQKVVDVLDSIKTKGKSADFTNFDPRGLLPESLDYWTLPGSLTTPPLLEC VTWIVLKEPISVSSEQVLKFRKLNFNGEGEPEELMVDNWRPAQPLKNRQIKA SFL | 5699 | 5700 |
| LibC000053 | CA2 (aa 2-260 of WT, V206M) | SHHWGYGKHNGPEHWHKDFPIAKGERQSPVDIDTHTAKYDPSLKPLSVSYD QATSLRILNNGHAFNVEFDDSQDKAVLKGGPLDGTYRLIQFHFHWGSLDGQ GSEHTVDKKKYAAELHLVHWNTKYGDFGKAVQQPDGLAVLGIFLKVGSAK PGLQKVVDVLDSIKTKGKSADFTNFDPRGLLPESLDYWTYPGSLTTPPLLEC MTWIVLKEPISVSSEQVLKFRKLNFNGEGEPEELMVDNWRPAQPLKNRQIK ASFK | 5701 | 5702 |
| LibC000054 | CA2 (aa 2-260 of WT, D71F, V241F, P249L) | SHHWGYGKHNGPEHWHKDFPIAKGERQSPVDIDTHTAKYDPSLKPLSVSYD QATSLRILNNGHAFNVEFFDSQDKAVLKGGPLDGTYRLIQFHFHWGSLDGQ GSEHTVDKKKYAAELHLVHWNTKYGDFGKAVQQPDGLAVLGIFLKVGSAK PGLQKVVDVLDSIKTKGKSADFTNFDPRGLLPESLDYWTYPGSLTTPPLLEC VTWIVLKEPISVSSEQVLKFRKLNFNGEGEPEELMFDNWRPAQLLKNRQIKA SFK | 5703 | 5704 |
| LibC000055 | CA2 (aa 2-260 of WT, Y193F) | SHHWGYGKHNGPEHWHKDFPIAKGERQSPVDIDTHTAKYDPSLKPLSVSYD QATSLRILNNGHAFNVEFDDSQDKAVLKGGPLDGTYRLIQFHFHWGSLDGQ GSEHTVDKKKYAAELHLVHWNTKYGDFGKAVQQPDGLAVLGIFLKVGSAK PGLQKVVDVLDSIKTKGKSADFTNFDPRGLLPESLDYWTFPGSLTTPPLLEC VTWIVLKEPISVSSEQVLKFRKLNFNGEGEPEELMVDNWRPAQPLKNRQIKA SFK | 5705 | 5706 |
| LibC000058 | CA2 (aa 2-260 of WT, L147F, Q248F) | SHHWGYGKHNGPEHWHKDFPIAKGERQSPVDIDTHTAKYDPSLKPLSVSYD QATSLRILNNGHAFNVEFDDSQDKAVLKGGPLDGTYRLIQFHFHWGSLDGQ GSEHTVDKKKYAAELHLVHWNTKYGDFGKAVQQPDGLAVLGIFFKVGSAK PGLQKVVDVLDSIKTKGKSADFTNFDPRGLLPESLDYWTYPGSLTTPPLLEC VTWIVLKEPISVSSEQVLKFRKLNFNGEGEPEELMVDNWRPAFPLKNRQIKA SFK | 5707 | 5708 |
| LibC000059 | CA2 (aa 2-260 of WT, D52I, S258P) | SHHWGYGKHNGPEHWHKDFPIAKGERQSPVDIDTHTAKYDPSLKPLSVSYI QATSLRILNNGHAFNVEFDDSQDKAVLKGGPLDGTYRLIQFHFHWGSLDGQ GSEHTVDKKKYAAELHLVHWNTKYGDFGKAVQQPDGLAVLGIFLKVGSAK PGLQKVVDVLDSIKTKGKSADFTNFDPRGLLPESLDYWTYPGSLTTPPLLEC VTWIVLKEPISVSSEQVLKFRKLNFNGEGEPEELMVDNWRPAQPLKNRQIKA PFK | 5709 | 5710 |
| LibC000060 | CA2 (aa 2-260 of WT, D72S, T192N) | SHHWGYGKHNGPEHWHKDFPIAKGERQSPVDIDTHTAKYDPSLKPLSVSYD QATSLRILNNGHAFNVEFDSSQDKAVLKGGPLDGTYRLIQFHFHWGSLDGQ GSEHTVDKKKYAAELHLVHWNTKYGDFGKAVQQPDGLAVLGIFLKVGSAK PGLQKVVDVLDSIKTKGKSADFTNFDPRGLLPESLDYWNYPGSLTTPPLLEC VTWIVLKEPISVSSEQVLKFRKLNFNGEGEPEELMVDNWRPAQPLKNRQIKA SFK | 5711 | 5712 |
| LibC000062 | CA2 (aa 2-260 of WT, D179E, T192I) | SHHWGYGKHNGPEHWHKDFPIAKGERQSPVDIDTHTAKYDPSLKPLSVSYD QATSLRILNNGHAFNVEFDDSQDKAVLKGGPLDGTYRLIQFHFHWGSLDGQ GSEHTVDKKKYAAELHLVHWNTKYGDFGKAVQQPDGLAVLGIFLKVGSAK PGLQKVVDVLDSIKTKGKSADFTNFEPRGLLPESLDYWIYPGSLTTPPLLECV TWIVLKEPISVSSEQVLKFRKLNFNGEGEPEELMVDNWRPAQPLKNRQIKAS FK | 5713 | 5714 |

TABLE 1-continued

| | CA2 DDs | | | |
|---|---|---|---|---|
| Library ID | Description | AA SEQUENCE | AA SEQ ID NO. | NA SEQ ID NO. |
| LibC000063 | CA2 (aa 2-260 of WT, Y193L) | SHHWGYGKHNGPEHWHKDFPIAKGERQSPVDIDTHTAKYDPSLKPLSVSYD QATSLRILNNGHAFNVEFDDSQDKAVLKGGPLDGTYRLIQFHFHWGSLDGQ GSEHTVDKKKYAAELHLVHWNTKYGDFGKAVQQPDGLAVLGIFLKVGSAK PGLQKVVDVLDSIKTKGKSADFTNFDPRGLLPESLDYWTLPGSLTTPPLLEC VTWIVLKEPISVSSEQVLKFRKLNFNGEGEPEELMVDNWRPAQPLKNRQIKA SFK | 5715 | 5716 |
| LibC000064 | CA2 (aa 2-260 of WT, S56N, Q103K) | SHHWGYGKHNGPEHWHKDFPIAKGERQSPVDIDTHTAKYDPSLKPLSVSYD QATNLRILNNGHAFNVEFDDSQDKAVLKGGPLDGTYRLIQFHFHWGSLDGK GSEHTVDKKKYAAELHLVHWNTKYGDFGKAVQQPDGLAVLGIFLKVGSAK PGLQKVVDVLDSIKTKGKSADFTNFDPRGLLPESLDYWTYPGSLTTPPLLEC VTWIVLKEPISVSSEQVLKFRKLNFNGEGEPEELMVDNWRPAQPLKNRQIKA SFK | 5717 | 5718 |
| LibC000067 | CA2 (aa 2-260 of WT, D71Y, Q248L) | SHHWGYGKHNGPEHWHKDFPIAKGERQSPVDIDTHTAKYDPSLKPLSVSYD QATSLRILNNGHAFNVEFYDSQDKAVLKGGPLDGTYRLIQFHFHWGSLDGQ GSEHTVDKKKYAAELHLVHWNTKYGDFGKAVQQPDGLAVLGIFLKVGSAK PGLQKVVDVLDSIKTKGKSADFTNFDPRGLLPESLDYWTYPGSLTTPPLLEC VTWIVLKEPISVSSEQVLKFRKLNFNGEGEPEELMVDNWRPALPLKNRQIKA SFK | 5719 | 5720 |
| LibC000068 | CA2 (aa 2-260 of WT, S73N, R89F) | SHHWGYGKHNGPEHWHKDFPIAKGERQSPVDIDTHTAKYDPSLKPLSVSYD QATSLRILNNGHAFNVEFDDNQDKAVLKGGPLDGTYFLIQFHFHWGSLDGQ GSEHTVDKKKYAAELHLVHWNTKYGDFGKAVQQPDGLAVLGIFLKVGSAK PGLQKVVDVLDSIKTKGKSADFTNFDPRGLLPESLDYWTYPGSLTTPPLLEC VTWIVLKEPISVSSEQVLKFRKLNFNGEGEPEELMVDNWRPAQPLKNRQIKA SFK | 5721 | 5722 |
| LibC000070 | CA2 (aa 2-260 of WT, D71K, N231L, E235G, L239F) | SHHWGYGKHNGPEHWHKDFPIAKGERQSPVDIDTHTAKYDPSLKPLSVSYD QATSLRILNNGHAFNVEFKDSQDKAVLKGGPLDGTYRLIQFHFHWGSLDGQ GSEHTVDKKKYAAELHLVHWNTKYGDFGKAVQQPDGLAVLGIFLKVGSAK PGLQKVVDVLDSIKTKGKSADFTNFDPRGLLPESLDYWTYPGSLTTPPLLEC VTWIVLKEPISVSSEQVLKFRKLNFLGEGGPEEMVDNWRPAQPLKNRQIKA SFK | 5723 | 5724 |
| LibC000071 | CA2 (aa 2-260 of WT, D71F) | SHHWGYGKHNGPEHWHKDFPIAKGERQSPVDIDTHTAKYDPSLKPLSVSYD QATSLRILNNGHAFNVEFFDSQDKAVLKGGPLDGTYRLIQFHFHWGSLDGQ GSEHTVDKKKYAAELHLVHWNTKYGDFGKAVQQPDGLAVLGIFLKVGSAK PGLQKVVDVLDSIKTKGKSADFTNFDPRGLLPESLDYWTYPGSLTTPPLLEC VTWIVLKEPISVSSEQVLKFRKLNFNGEGEPEELMVDNWRPAQPLKNRQIKA SFK | 5725 | 5726 |
| LibC000072 | CA2 (aa 2-260 of WT, D72F, P249I) | SHHWGYGKHNGPEHWHKDFPIAKGERQSPVDIDTHTAKYDPSLKPLSVSYD QATSLRILNNGHAFNVEFDFSQDKAVLKGGPLDGTYRLIQFHFHWGSLDGQ GSEHTVDKKKYAAELHLVHWNTKYGDFGKAVQQPDGLAVLGIFLKVGSAK PGLQKVVDVLDSIKTKGKSADFTNFDPRGLLPESLDYWTYPGSLTTPPLLEC VTWIVLKEPISVSSEQVLKFRKLNFNGEGEPEELMVDNWRPAQILKNRQIKA SFK | 5727 | 5728 |
| LibC000074 | CA2 (aa 2-260 of WT, T192N) | SHHWGYGKHNGPEHWHKDFPIAKGERQSPVDIDTHTAKYDPSLKPLSVSYD QATSLRILNNGHAFNVEFDDSQDKAVLKGGPLDGTYRLIQFHFHWGSLDGQ GSEHTVDKKKYAAELHLVHWNTKYGDFGKAVQQPDGLAVLGIFLKVGSAK PGLQKVVDVLDSIKTKGKSADFTNFDPRGLLPESLDYWNYPGSLTTPPLLEC VTWIVLKEPISVSSEQVLKFRKLNFNGEGEPEELMVDNWRPAQPLKNRQIKA SFK | 5729 | 5730 |
| LibC000075 | CA2 (aa 2-260 of WT, D72X, V241X, P249X) | SHHWGYGKHNGPEHWHKDFPIAKGERQSPVDIDTHTAKYDPSLKPLSVSYD QATSLRILNNGHAFNVEFDXSQDKAVLKGGPLDGTYRLIQFHFHWGSLDGQ GSEHTVDKKKYAAELHLVHWNTKYGDFGKAVQQPDGLAVLGIFLKVGSAK PGLQKVVDVLDSIKTKGKSADFTNFDPRGLLPESLDYWTYPGSLTTPPLLEC VTWIVLKEPISVSSEQVLKFRKLNFNGEGEPEELMXDNWRPAQXLKNRQIK ASFK | 5731 | 5732 |
| LibC000077 | CA2 (aa 2-260 of WT, A54X, S56X, L57X, T192X) | SHHWGYGKHNGPEHWHKDFPIAKGERQSPVDIDTHTAKYDPSLKPLSVSYD QXTXXRILNNGHAFNVEFDDSQDKAVLKGGPLDGTYRLIQFHFHWGSLDGQ GSEHTVDKKKYAAELHLVHWNTKYGDFGKAVQQPDGLAVLGIFLKVGSAK PGLQKVVDVLDSIKTKGKSADFTNFDPRGLLPESLDYWXYPGSLTTPPLLEC VTWIVLKEPISVSSEQVLKFRKLNFNGEGEPEELMVDNWRPAQPLKNRQIKA SFK | 5733 | 5734 |
| LibC000080 | CA2 (aa 2-260 of WT, | SHHWGYGKHNGPEHWHKDFPIAKGERQSPVDIDTHTAKYDPSLKPLSVSYD QATSLRILNNGHAFNVEFDDSQDKAVLKGGPLDGTYRLIQFHFHWGSLDGQ | 5735 | 5736 |

TABLE 1-continued

| | | | | |
|---|---|---|---|---|
| | | CA2 DDs | | |
| Library ID | Description | AA SEQUENCE | AA SEQ ID NO. | NA SEQ ID NO. |
| | Y193V, K260F) | GSEHTVDKKKYAAELHLVHWNTKYGDFGKAVQQPDGLAVLGIFLKVGSAK PGLQKVVDVLDSIKTKGKSADFTNFDPRGLLPESLDYWTVPGSLTTPPLLEC VTWIVLKEPISVSSEQVLKFRKLNFNGEGEPEELMVDNWRPAQPLKNRQIKA SFF | | |
| LibC000085 | CA2 (aa 2-260 of WT, G63D, M240L) | SHHWGYGKHNGPEHWHKDFPIAKGERQSPVDIDTHTAKYDPSLKPLSVSYD QATSLRILNNDHAFNVEFDDSQDKAVLKGGPLDGTYRLIQFHFHWGSLDGQ GSEHTVDKKKYAAELHLVHWNTKYGDFGKAVQQPDGLAVLGIFLKVGSAK PGLQKVVDVLDSIKTKGKSADFTNFDPRGLLPESLDYWTYPGSLTTPPLLEC VTWIVLKEPISVSSEQVLKFRKLNFNGEGEPEELLVDNWRPAQPLKNRQIKA SFK | 5737 | 5738 |
| LibC000086 | CA2 (aa 2-260 of WT, V134F, L228F) | SHHWGYGKHNGPEHWHKDFPIAKGERQSPVDIDTHTAKYDPSLKPLSVSYD QATSLRILNNGHAFNVEFDDSQDKAVLKGGPLDGTYRLIQFHFHWGSLDGQ GSEHTVDKKKYAAELHLVHWNTKYGDFGKAFQQPDGLAVLGIFLKVGSAK PGLQKVVDVLDSIKTKGKSADFTNFDPRGLLPESLDYWTYPGSLTTPPLLEC VTWIVLKEPISVSSEQVLKFRKFNFNGEGEPEELMVDNWRPAQPLKNRQIKA SFK | 5739 | 5740 |
| LibC000087 | CA2 (aa 2-260 of WT, D71G, N231K) | SHHWGYGKHNGPEHWHKDFPIAKGERQSPVDIDTHTAKYDPSLKPLSVSYD QATSLRILNNGHAFNVEFGDSQDKAVLKGGPLDGTYRLIQFHFHWGSLDGQ GSEHTVDKKKYAAELHLVHWNTKYGDFGKAVQQPDGLAVLGIFLKVGSAK PGLQKVVDVLDSIKTKGKSADFTNFDPRGLLPESLDYWTYPGSLTTPPLLEC VTWIVLKEPISVSSEQVLKFRKLNFKGEGEPEELMVDNWRPAQPLKNRQIKA SFK | 5741 | 5742 |
| LibC000088 | CA2 (aa 2-260 of WT, S56F, D71S) | SHHWGYGKHNGPEHWHKDFPIAKGERQSPVDIDTHTAKYDPSLKPLSVSYD QATFLRILNNGHAFNVEFSDSQDKAVLKGGPLDGTYRLIQFHFHWGSLDGQ GSEHTVDKKKYAAELHLVHWNTKYGDFGKAVQQPDGLAVLGIFLKVGSAK PGLQKVVDVLDSIKTKGKSADFTNFDPRGLLPESLDYWTYPGSLTTPPLLEC VTWIVLKEPISVSSEQVLKFRKLNFNGEGEPEELMVDNWRPAQPLKNRQIKA SFK | 5743 | 5744 |
| LibC000089 | CA2 (aa 2-260 of WT, D52L, G128R, Q248F) | SHHWGYGKHNGPEHWHKDFPIAKGERQSPVDIDTHTAKYDPSLKPLSVSYL QATSLRILNNGHAFNVEFDDSQDKAVLKGGPLDGTYRLIQFHFHWGSLDGQ GSEHTVDKKKYAAELHLVHWNTKYRDFGKAVQQPDGLAVLGIFLKVGSAK PGLQKVVDVLDSIKTKGKSADFTNFDPRGLLPESLDYWTYPGSLTTPPLLEC VTWIVLKEPISVSSEQVLKFRKLNFNGEGEPEELMVDNWRPAFPLKNRQIKA SFK | 5745 | 5746 |
| LibC000091 | CA2 (aa 2-260 of WT, S73X, R89X) | SHHWGYGKHNGPEHWHKDFPIAKGERQSPVDIDTHTAKYDPSLKPLSVSYD QATSLRILNNGHAFNVEFDDXQDKAVLKGGPLDGTYXLIQFHFHWGSLDGQ GSEHTVDKKKYAAELHLVHWNTKYGDFGKAVQQPDGLAVLGIFLKVGSAK PGLQKVVDVLDSIKTKGKSADFTNFDPRGLLPESLDYWTYPGSLTTPPLLEC VTWIVLKEPISVSSEQVLKFRKLNFNGEGEPEELMVDNWRPAQPLKNRQIKA SFK | 5747 | 5748 |
| LibC000093 | CA2 (aa 2-260 of WT, Y193X) | SHHWGYGKHNGPEHWHKDFPIAKGERQSPVDIDTHTAKYDPSLKPLSVSYD QATSLRILNNGHAFNVEFDDSQDKAVLKGGPLDGTYRLIQFHFHWGSLDGQ GSEHTVDKKKYAAELHLVHWNTKYGDFGKAVQQPDGLAVLGIFLKVGSAK PGLQKVVDVLDSIKTKGKSADFTNFDPRGLLPESLDYWTXPGSLTTPPLLEC VTWIVLKEPISVSSEQVLKFRKLNFNGEGEPEELMVDNWRPAQPLKNRQIKA SFK | 5749 | 5750 |
| LibC000096 | CA2 (aa 2-260 of WT, Y51X, D72X, V241X, P249X) | SHHWGYGKHNGPEHWHKDFPIAKGERQSPVDIDTHTAKYDPSLKPLSVSXD QATSLRILNNGHAFNVEFDXSQDKAVLKGGPLDGTYRLIQFHFHWGSLDGQ GSEHTVDKKKYAAELHLVHWNTKYGDFGKAVQQPDGLAVLGIFLKVGSAK PGLQKVVDVLDSIKTKGKSADFTNFDPRGLLPESLDYWTYPGSLTTPPLLEC VTWIVLKEPISVSSEQVLKFRKLNFNGEGEPEELMXDNWRPAQXLKNRQIK ASFK | 5751 | 5752 |
| LibC000100 | CA2 (aa 2-260 of WT, D72I, W97C) | SHHWGYGKHNGPEHWHKDFPIAKGERQSPVDIDTHTAKYDPSLKPLSVSYD QATSLRILNNGHAFNVEFDISQDKAVLKGGPLDGTYRLIQFHFHCGSLDGQ SEHTVDKKKYAAELHLVHWNTKYGDFGKAVQQPDGLAVLGIFLKVGSAKP GLQKVVDVLDSIKTKGKSADFTNFDPRGLLPESLDYWTYPGSLTTPPLLECV TWIVLKEPISVSSEQVLKFRKLNFNGEGEPEELMVDNWRPAQPLKNRQIKAS FK | 5753 | 5754 |
| LibC000102 | CA2 (aa 2-260 of WT, D71K, T192F, N231F) | SHHWGYGKHNGPEHWHKDFPIAKGERQSPVDIDTHTAKYDPSLKPLSVSYD QATSLRILNNGHAFNVEFKDSQDKAVLKGGPLDGTYRLIQFHFHWGSLDGQ GSEHTVDKKKYAAELHLVHWNTKYGDFGKAVQQPDGLAVLGIFLKVGSAK PGLQKVVDVLDSIKTKGKSADFTNFDPRGLLPESLDYWFYPGSLTTPPLLEC VTWIVLKEPISVSSEQVLKFRKLNFFGEGEPEELMVDNWRPAQPLKNRQIKA SFK | 5755 | 5756 |

TABLE 1-continued

| | | | AA SEQ | NA SEQ |
|---|---|---|---|---|
| Library ID | Description | AA SEQUENCE | ID NO. | ID NO. |

CA2 DDs

| — | CA2 (aa 2-260 of WT, I59N, G102R) | SHHWGYGKHNGPEHWHKDFPIAKGERQSPVDIDTHTAKYDPSLKPLSVSYD QATSLRNLNNGHAFNVEFDDSQDKAVLKGGPLDGTYRLIQFHFHWGSLDR QGSEHTVDKKKYAAELHLVHWNTKYGDFGKAVQQPDGLAVLGIFLKVGSA KPGLQKVVDVLDSIKTKGKSADFTNFDPRGLLPESLDYWTYPGSLTTPPLLE CVTWIVLKEPISVSSEQVLKFRKLNFNGEGEPEELMVDNWRPAQPLKNRQIK ASFK | 5757 | 5758 5813 5814 5815 |
| LibC000210 LibC000184 LibC000187 | | | | |
| — | CA2 (aa 2-260 of WT, L156H) | SHHWGYGKHNGPEHWHKDFPIAKGERQSPVDIDTHTAKYDPSLKPLSVSYD QATSLRILNNGHAFNVEFDDSQDKAVLKGGPLDGTYRLIQFHFHWGSLDGQ GSEHTVDKKKYAAELHLVHWNTKYGDFGKAVQQPDGLAVLGIFLKVGSAK PGHQKVVDVLDSIKTKGKSADFTNFDPRGLLPESLDYWTYPGSLTTPPLLEC VTWIVLKEPISVSSEQVLKFRKLNFNGEGEPEELMVDNWRPAQPLKNRQIKA SFK | 5759 | 5760 5816 |
| LibC000208 | | | | |
| — | CA2 (L156H) | MSHHWGYGKHNGPEHWHKDFPIAKGERQSPVDIDTHTAKYDPSLKPLSVSY DQATSLRILNNGHAFNVEFDDSQDKAVLKGGPLDGTYRLIQFHFHWGSLDG QGSEHTVDKKKYAAELHLVHWNTKYGDFGKAVQQPDGLAVLGIFLKVGSA KPGHQKVVDVLDSIKTKGKSADFTNFDPRGLLPESLDYWTYPGSLTTPPLLE CVTWIVLKEPISVSSEQVLKFRKLNFNGEGEPEELMVDNWRPAQPLKNRQIK ASFK | 5761 | 5762 |
| LibC000061 truncated | CA2 (aa 2-237 of WT) | SHHWGYGKHNGPEHWHKDFPIAKGERQSPVDIDTHTAKYDPSLKPLSVSYD QATSLRILNNGHAFNVEFDDSQDKAVLKGGPLDGTYRLIQFHFHWGSLDGQ GSEHTVDKKKYAAELHLVHWNTKYGDFGKAVQQPDGLAVLGIFLKVGSAK PGLQKVVDVLDSIKTKGKSADFTNFDPRGLLPESLDYWTYPGSLTTPPLLEC VTWIVLKEPISVSSEQVLKFRKLNFNGEGEPE | 5695 | 5812 |

Additional CA2 destabilizing domains are provided in Table 2.

TABLE 2

CA2 DDs

| | | | AA SEQ ID NO. | NA SEQ ID NO. |
|---|---|---|---|---|
| Library ID | Description | AA SEQUENCE | | |

| LibC000229 | CA2 (aa 2-260 of WT, H36Q, S43T, Y51F, N67D, G131W, R226H) | SHHWGYGKHNGPEHWHKDFPIAKGERQSPVDIDTQTAKYDPTLKPLSVSFD QATSLRILNNGHAFDVEFDDSQDKAVLKGGPLDGTYRLIQFHFHWGSLDGQ GSEHTVDKKKYAAELHLVHWNTKYGDFWKAVQQPDGLAVLGIFLKVGSA KPGLQKVVDVLDSIKTKGKSADFTNFDPRGLLPESLDYWTYPGSLTTPPLLE CVTWIVLKEPISVSSEQVLKFHKLNFNGEGEPEELMVDNWRPAQPLKNRQIK ASFK | 5817 | 5818 |
| LibC000228 | CA2 (aa 2-260 of WT, F70I, F146V) | SHHWGYGKHNGPEHWHKDFPIAKGERQSPVDIDTHTAKYDPSLKPLSVSYD QATSLRILNNGHAFNVEIDDSQDKAVLKGGPLDGTYRLIQFHFHWGSLDGQ GSEHTVDKKKYAAELHLVHWNTKYGDFGKAVQQPDGLAVLGIVLKVGSA KPGLQKVVDVLDSIKTKGKSADFTNFDPRGLLPESLDYWTYPGSLTTPPLLE CVTWIVLKEPISVSSEQVLKFRKLNFNGEGEPEELMVDNWRPAQPLKNRQIK ASFK | 5819 | 5820 |
| LibC000226 | CA2 (aa 2-260 of WT, R27L, T87I, H122Y, N252D) | SHHWGYGKHNGPEHWHKDFPIAKGELQSPVDIDTHTAKYDPSLKPLSVSYD QATSLRILNNGHAFNVEFDDSQDKAVLKGGPLDGIYRLIQFHFHWGSLDGQ GSEHTVDKKKYAAELHLVYWNTKYGDFGKAVQQPDGLAVLGIFLKVGSA KPGLQKVVDVLDSIKTKGKSADFTNFDPRGLLPESLDYWTYPGSLTTPPLLE CVTWIVLKEPISVSSEQVLKFRKLNFNGEGEPEELMVDNWRPAQPLKDRQIK ASFK | 5821 | 5822 |
| LibC000225 | CA2 (aa 2-260 of WT, K45N, V68L, H119Y, K169R, D179E) | SHHWGYGKHNGPEHWHKDFPIAKGERQSPVDIDTHTAKYDPSLNPLSVSYD QATSLRILNNGHAFNLEFDDSQDKAVLKGGPLDGTYRLIQFHFHWGSLDGQ GSEHTVDKKKYAAELYLVHWNTKYGDFGKAVQQPDGLAVLGIFLKVGSA KPGLQKVVDVLDSIKTRGKSADFTNFEPRGLLPESLDYWTYPGSLTTPPLLE CVTWIVLKEPISVSSEQVLKFRKLNFNGEGEPEELMVDNWRPAQPLKNRQIK ASFK | 5823 | 5824 |
| LibC000224 | CA2 (aa 2-260 of WT, H15L, | SHHWGYGKHNGPELWHKDFPIAKGERQSPVDIDTHTAKYDPSLKPLSVSYD QVTSLRILNNGHAFNVEFDDSQDKAVLKGGPLDGTYRLIQFHFHWGSLDGQ | 5825 | 5826 |

TABLE 2-continued

| | | | AA SEQ ID NO. | NA SEQ ID NO. |
|---|---|---|---|---|

CA2 DDs

| Library ID | Description | AA SEQUENCE | AA SEQ ID NO. | NA SEQ ID NO. |
|---|---|---|---|---|
| | A54V, K111E, E220K, F225I) | GSEHTVDEKKYAAELHLVHWNTKYGDFGKAVQQPDGLAVLGIFLKVGSAK PGLQKVVDVLDSIKTKGKSADFTNFDPRGLLPESLDYWTYPGSLTTPPLLEC VTWIVLKEPISVSSKQVLKIRKLNFNGEGEPEELMVDNWRPAQPLKNRQIKA SFK | | |
| LibC000221 | CA2 (aa 2-260 of WT, P13S, P83A, D101G, K111N, F230I) | SHHWGYGKHNGSEHWHKDFPIAKGERQSPVDIDTHTAKYDPSLKPLSVSYD QATSLRILNNGHAFNVEFDDSQDKAVLKGGALDGTYRLIQFHFHWGSLGGQ GSEHTVDNKKYAAELHLVHWNTKYGDFGKAVQQPDGLAVLGIFLKVGSA KPGLQKVVDVLDSIKTKGKSADFTNFDPRGLLPESLDYWTYPGSLTTPPLLE CVTWIVLKEPISVSSEQVLKFRKLNINGEGEPEELMVDNWRPAQPLKNRQIK ASFK | 5827 | 5828 |
| LibC000220 | CA2 (aa 2-260 of WT, L47R) | SHHWGYGKHNGPEHWHKDFPIAKGERQSPVDIDTHTAKYDPSLKPRSVSYD QATSLRILNNGHAFNVEFDDSQDKAVLKGGPLDGTYRLIQFHFHWGSLDGQ GSEHTVDKKKYAAELHLVHWNTKYGDFGKAVQQPDGLAVLGIFLKVGSA KPGLQKVVDVLDSIKTKGKSADFTNFDPRGLLPESLDYWTYPGSLTTPPLLE CVTWIVLKEPISVSSEQVLKFRKLNFNGEGEPEELMVDNWRPAQPLKNRQIK ASFK | 5829 | 5830 |
| LibC000219 | CA2 (aa 2-260 of WT, G63D, W123R, E220K) | SHHWGYGKHNGPEHWHKDFPIAKGERQSPVDIDTHTAKYDPSLKPLSVSYD QATSLRILNNDHAFNVEFDDSQDKAVLKGGPLDGTYRLIQFHFHWGSLDGQ GSEHTVDKKKYAAELHLVHRNTKYGDFGKAVQQPDGLAVLGIFLKVGSA PGLQKVVDVLDSIKTKGKSADFTNFDPRGLLPESLDYWTYPGSLTTPPLLEC VTWIVLKEPISVSSKQVLKFRKLNFNGEGEPEELMVDNWRPAQPLKNRQIK ASFK | 5831 | 5832 |
| LibC000217 | CA2 (aa 2-260 of WT, N11D, E69K, G86D, V109M, K113I, T125I, D138G, G155S) | SHHWGYGKHDGPEHWHKDFPIAKGERQSPVDIDTHTAKYDPSLKPLSVSYD QATSLRILNNGHAFNVKFDDSQDKAVLKGGPLDDTYRLIQFHFHWGSLDGQ GSEHTMDKKIYAAELHLVHWNIKYGDFGKAVQQPGGLAVLGIFLKVGSAK PSLQKVVDVLDSIKTKGKSADFTNFDPRGLLPESLDYWTYPGSLTTPPLLEC VTWIVLKEPISVSSEQVLKFRKLNFNGEGEPEELMVDNWRPAQPLKNRQIKA SFK | 5833 | 5834 |
| LibC000214 | CA2 (aa 2-260 of WT, I59N, G102R, A173T) | SHHWGYGKHNGPEHWHKDFPIAKGERQSPVDIDTHTAKYDPSLKPLSVSYD QATSLRNLNNGHAFNVEFDDSQDKAVLKGGPLDGTYRLIQFHFHWGSLDR QGSEHTVDKKKYAAELHLVHWNTKYGDFGKAVQQPDGLAVLGIFLKVGS AKPGLQKVVDVLDSIKTKGKSTDFTNFDPRGLLPESLDYWTYPGSLTTPPLL ECVTWIVLKEPISVSSEQVLKFRKLNFNGEGEPEELMVDNWRPAQPLKNRQI KASFK | 5835 | 5836 |
| LibC000213 | CA2 (aa 2-260 of WT, L79F, P180S) | SHHWGYGKHNGPEHWHKDFPIAKGERQSPVDIDTHTAKYDPSLKPLSVSYD QATSLRILNNGHAFNVEFDDSQDKAVFKGGPLDGTYRLIQFHFHWGSLDGQ GSEHTVDKKKYAAELHLVHWNTKYGDFGKAVQQPDGLAVLGIFLKVGSA KPGLQKVVDVLDSIKTKGKSADFTNFDSRGLLPESLDYWTYPGSLTTPPLLE CVTWIVLKEPISVSSEQVLKFRKLNFNGEGEPEELMVDNWRPAQPLKNRQIK ASFK | 5837 | 5838 |
| LibC000212 | CA2 (aa 2-260 of WT, S73F) | SHHWGYGKHNGPEHWHKDFPIAKGERQSPVDIDTHTAKYDPSLKPLSVSYD QATSLRILNNGHAFNVEFDDFQDKAVLKGGPLDGTYRLIQFHFHWGSLDGQ GSEHTVDKKKYAAELHLVHWNTKYGDFGKAVQQPDGLAVLGIFLKVGSA KPGLQKVVDVLDSIKTKGKSADFTNFDPRGLLPESLDYWTYPGSLTTPPLLE CVTWIVLKEPISVSSEQVLKFRKLNFNGEGEPEELMVDNWRPAQPLKNRQIK ASFK | 5839 | 5840 |
| LibC000211 | CA2 (aa 2-260 of WT, G12R) | SHHWGYGKHNRPEHWHKDFPIAKGERQSPVDIDTHTAKYDPSLKPLSVSYD QATSLRILNNGHAFNVEFDDSQDKAVLKGGPLDGTYRLIQFHFHWGSLDGQ GSEHTVDKKKYAAELHLVHWNTKYGDFGKAVQQPDGLAVLGIFLKVGSA KPGLQKVVDVLDSIKTKGKSADFTNFDPRGLLPESLDYWTYPGSLTTPPLLE CVTWIVLKEPISVSSEQVLKFRKLNFNGEGEPEELMVDNWRPAQPLKNRQIK ASFK | 5841 | 5842 |
| LibC000209 | CA2 (aa 2-260 of WT, A77P, G102R, D138N) | SHHWGYGKHNGPEHWHKDFPIAKGERQSPVDIDTHTAKYDPSLKPLSVSYD QATSLRILNNGHAFNVEFDDSQDKPVLKGGPLDGTYRLIQFHFHWGSLDRQ GSEHTVDKKKYAAELHLVHWNTKYGDFGKAVQQPNGLAVLGIFLKVGSA KPGLQKVVDVLDSIKTKGKSADFTNFDPRGLLPESLDYWTYPGSLTTPPLLE CVTWIVLKEPISVSSEQVLKFRKLNFNGEGEPEELMVDNWRPAQPLKNRQIK ASFK | 5843 | 5844 |
| LibC000183 | CA2 (aa 2-260 of WT, F20L, K45N, G63D, | SHHWGYGKHNGPEHWHKDLPIAKGERQSPVDIDTHTAKYDPSLNPLSVSYD QATSLRILNNDHAFNVVFDDSQDKAVLKGGPLDGTYRLIQFHFHWGSLDGQ GSEHTVDKKKYAAELHLVHWNTKYGDFGKAVQQPDGLAVLGIFLKVGSA | 5845 | 5846 |

TABLE 2-continued

| | | CA2 DDs | | |
|---|---|---|---|---|
| Library ID | Description | AA SEQUENCE | AA SEQ ID NO. | NA SEQ ID NO. |
| | E69V, N231I) | KPGLQKVVDVLDSIKTKGKSADFTNFDPRGLLPESLDYWTYPGSLTTPPLLE CVTWIVLKEPISVSSEQVLKFRKLNFIGEGEPEELMVDNWRPAQPLKNRQIK ASFK | | |
| LibC000207 | CA2 (aa 2-260 of WT, T199N, L202P, L228F) | SHHWGYGKHNGPEHWHKDFPIAKGERQSPVDIDTHTAKYDPSLKPLSVSYD QATSLRILNNGHAFNVEFDDSQDKAVLKGGPLDGTYRLIQFHFHWGSLDGQ GSEHTVDKKKYAAELHLVHWNTKYGDFGKAVQQPDGLAVLGIFLKVGSA KPGLQKVVDVLDSIKTKGKSADFTNFDPRGLLPESLDYWTYPGSLTNPPPLE CVTWIVLKEPISVSSEQVLKFRKFNFNGEGEPEELMVDNWRPAQPLKNRQIK ASFK | 5847 | 5848 |
| LibC000206 | CA2 (aa 2-260 of WT, K9N, H122Y, T168K) | SHHWGYGNHNGPEHWHKDFPIAKGERQSPVDIDTHTAKYDPSLKPLSVSYD QATSLRILNNGHAFNVEFDDSQDKAVLKGGPLDGTYRLIQFHFHWGSLDGQ GSEHTVDKKKYAAELHLVYWNTKYGDFGKAVQQPDGLAVLGIFLKVGSA KPGLQKVVDVLDSIKKKGKSADFTNFDPRGLLPESLDYWTYPGSLTTPPLLE CVTWIVLKEPISVSSEQVLKFRKLNFNGEGEPEELMVDNWRPAQPLKNRQIK ASFK | 5849 | 5850 |
| LibC000205 | CA2 (aa 2-260 of WT, Q53H, L90V, Q92H, G131E) | SHHWGYGKHNGPEHWHKDFPIAKGERQSPVDIDTHTAKYDPSLKPLSVSYD HATSLRILNNGHAFNVEFDDSQDKAVLKGGPLDGTYRVIHFHFHWGSLDGQ GSEHTVDKKKYAAELHLVHWNTKYGDFEKAVQQPDGLAVLGIFLKVGSAK PGLQKVVDVLDSIKTKGKSADFTNFDPRGLLPESLDYWTYPGSLTTPPLLEC VTWIVLKEPISVSSEQVLKFRKLNFNGEGEPEELMVDNWRPAQPLKNRQIKA SFK | 5851 | 5852 |
| LibC000204 | CA2 (aa 2-260 of WT, L44M, L47V, N62K, E69D) | SHHWGYGKHNGPEHWHKDFPIAKGERQSPVDIDTHTAKYDPSMKPVSVSY DQATSLRILNKGHAFNVDFDDSQDKAVLKGGPLDGTYRLIQFHFHWGSLDG QGSEHTVDKKKYAAELHLVHWNTKYGDFGKAVQQPDGLAVLGIFLKVGS AKPGLQKVVDVLDSIKTKGKSADFTNFDPRGLLPESLDYWTYPGSLTTPPLL ECVTWIVLKEPISVSSEQVLKFRKLNFNGEGEPEELMVDNWRPAQPLKNRQI KASFK | 5853 | 5854 |
| LibC000203 | CA2 (aa 2-260 of WT, F20L, K45N, G104R, A116V) | SHHWGYGKHNGPEHWHKDLPIAKGERQSPVDIDTHTAKYDPSLNPLSVSYD QATSLRILNNGHAFNVEFDDSQDKAVLKGGPLDGTYRLIQFHFHWGSLDGQ RSEHTVDKKKYAVELHLVHWNTKYGDFGKAVQQPDGLAVLGIFLKVGSA KPGLQKVVDVLDSIKTKGKSADFTNFDPRGLLPESLDYWTYPGSLTTPPLLE CVTWIVLKEPISVSSEQVLKFRKLNFNGEGEPEELMVDNWRPAQPLKNRQIK ASFK | 5855 | 5856 |
| LibC000202 | CA2 (aa 2-260 of WT, D75V, K169N, F259L) | SHHWGYGKHNGPEHWHKDFPIAKGERQSPVDIDTHTAKYDPSLKPLSVSYD QATSLRILNNGHAFNVEFDDSQVKAVLKGGPLDGTYRLIQFHFHWGSLDGQ GSEHTVDKKKYAAELHLVHWNTKYGDFGKAVQQPDGLAVLGIFLKVGSA KPGLQKVVDVLDSIKTNGKSADFTNFDPRGLLPESLDYWTYPGSLTTPPLLE CVTWIVLKEPISVSSEQVLKFRKLNFNGEGEPEELMVDNWRPAQPLKNRQIK ASLK | 5857 | 5858 |
| LibC000182 | CA2 (aa 2-260 of WT, T207S, V222A, N231D) | SHHWGYGKHNGPEHWHKDFPIAKGERQSPVDIDTHTAKYDPSLKPLSVSYD QATSLRILNNGHAFNVEFDDSQDKAVLKGGPLDGTYRLIQFHFHWGSLDGQ GSEHTVDKKKYAAELHLVHWNTKYGDFGKAVQQPDGLAVLGIFLKVGSA KPGLQKVVDVLDSIKTKGKSADFTNFDPRGLLPESLDYWTYPGSLTTPPLLE CVSWIVLKEPISVSSEQALKFRKLNFDGEGEPEELMVDNWRPAQPLKNRQIK ASFK | 5859 | 5860 |
| LibC000201 | CA2 (aa 2-260 of WT, I59F, V206M, G232R) | SHHWGYGKHNGPEHWHKDFPIAKGERQSPVDIDTHTAKYDPSLKPLSVSYD QATSLRFLNNGHAFNVEFDDSQDKAVLKGGPLDGTYRLIQFHFHWGSLDG QGSEHTVDKKKYAAELHLVHWNTKYGDFGKAVQQPDGLAVLGIFLKVGS AKPGLQKVVDVLDSIKTKGKSADFTNFDPRGLLPESLDYWTYPGSLTTPPLL ECMTWIVLKEPISVSSEQVLKFRKLNFNREGEPEELMVDNWRPAQPLKNRQI KASFK | 5861 | 5862 |
| LibC000199 | CA2 (aa 2-260 of WT, P13A, A133T) | SHHWGYGKHNGAEHWHKDFPIAKGERQSPVDIDTHTAKYDPSLKPLSVSY DQATSLRILNNGHAFNVEFDDSQDKAVLKGGPLDGTYRLIQFHFHWGSLDG QGSEHTVDKKKYAAELHLVHWNTKYGDFGKTVQQPDGLAVLGIFLKVGSA KPGLQKVVDVLDSIKTKGKSADFTNFDPRGLLPESLDYWTYPGSLTTPPLLE CVTWIVLKEPISVSSEQVLKFRKLNFNGEGEPEELMVDNWRPAQPLKNRQIK ASFK | 5863 | 5864 |
| LibC000198 | CA2 (aa 2-260 of WT, N61R, K80M, K212N, N231T, L250P) | SHHWGYGKHNGPEHWHKDFPIAKGERQSPVDIDTHTAKYDPSLKPLSVSYD QATSLRILRNGHAFNVEFDDSQDKAVLMGGPLDGTYRLIQFHFHWGSLDGQ GSEHTVDKKKYAAELHLVHWNTKYGDFGKAVQQPDGLAVLGIFLKVGSA KPGLQKVVDVLDSIKTKGKSADFTNFDPRGLLPESLDYWTYPGSLTTPPLLE CVTWIVLNEPISVSSEQVLKFRKLNFTGEGEPEELMVDNWRPAQPPKNRQIK ASFK | 5865 | 5866 |

TABLE 2-continued

CA2 DDs

| Library ID | Description | AA SEQUENCE | AA SEQ ID NO. | NA SEQ ID NO. |
|---|---|---|---|---|
| LibC000196 | CA2 (aa 2-260 of WT, G63D, E69V, N231I) | SHHWGYGKHNGPEHWHKDFPIAKGERQSPVDIDTHTAKYDPSLKPLSVSYD QATSLRILNNDHAFNVVFDDSQDKAVLKGGPLDGTYRLIQFHFHWGSLDGQ GSEHTVDKKKYAAELHLVHWNTKYGDFGKAVQQPDGLAVLGIFLKVGSA KPGLQKVVDVLDSIKTKGKSADFTNFDPRGLLPESLDYWTYPGSLTTPPLLE CVTWIVLKEPISVSSEQVLKFRKLNFIGEGEPEELMVDNWRPAQPLKNRQIK ASFK | 5867 | 5868 |
| LibC000181 | CA2 (aa 2-260 of WT, I59N, R89I) | SHHWGYGKHNGPEHWHKDFPIAKGERQSPVDIDTHTAKYDPSLKPLSVSYD QATSLRNLNNGHAFNVEFDDSQDKAVLKGGPLDGTYILIQFHFHWGSLDGQ GSEHTVDKKKYAAELHLVHWNTKYGDFGKAVQQPDGLAVLGIFLKVGSA KPGLQKVVDVLDSIKTKGKSADFTNFDPRGLLPESLDYWTYPGSLTTPPLLE CVTWIVLKEPISVSSEQVLKFRKLNFNGEGEPEELMVDNWRPAQPLKNRQIK ASFK | 5869 | 5870 |
| LibC000194 | CA2 (aa 2-260 of WT, A65N, G86D, G131R, G155D, K158N, V162A, G170D, P236L) | SHHWGYGKHNGPEHWHKDFPIAKGERQSPVDIDTHTAKYDPSLKPLSVSYD QATSLRILNNGHNFNVEFDDSQDKAVLKGGPLDDTYRLIQFHFHWGSLDGQ GSEHTVDKKKYAAELHLVHWNTKYGDFRKAVQQPDGLAVLGIFLKVGSA KPDLQNVVDALDSIKTKDKSADFTNFDPRGLLPESLDYWTYPGSLTTPPLLE CVTWIVLKEPISVSSEQVLKFRKLNFNGEGELEELMVDNWRPAQPLKNRQIK ASFK | 5871 | 5872 |
| LibC000192 | CA2 (aa 2-260 of WT, G12R, H15Y, D19V) | SHHWGYGKHNRPEYWHKVFPIAKGERQSPVDIDTHTAKYDPSLKPLSVSYD QATSLRILNNGHAFNVEFDDSQDKAVLKGGPLDGTYRLIQFHFHWGSLDGQ GSEHTVDKKKYAAELHLVHWNTKYGDFGKAVQQPDGLAVLGIFLKVGSA KPGLQKVVDVLDSIKTKGKSADFTNFDPRGLLPESLDYWTYPGSLTTPPLLE CVTWIVLKEPISVSSEQVLKFRKLNFNGEGEPEELMVDNWRPAQPLKNRQIK ASFK | 5873 | 5874 |
| LibC000193 | CA2 (aa 2-260 of WT, L156H, S172C, F178Y, E186D) | SHHWGYGKHNGPEHWHKDFPIAKGERQSPVDIDTHTAKYDPSLKPLSVSYD QATSLRILNNGHAFNVEFDDSQDKAVLKGGPLDGTYRLIQFHFHWGSLDGQ GSEHTVDKKKYAAELHLVHWNTKYGDFGKAVQQPDGLAVLGIFLKVGSA KPGHQKVVDVLDSIKTKGKCADFTNYDPRGLLPDSLDYWTYPGSLTTPPLL ECVTWIVLKEPISVSSEQVLKFRKLNFNGEGEPEELMVDNWRPAQPLKNRQI KASFK | 5875 | 5876 |
| LibC000189 | CA2 (aa 2-260 of WT, A65V, F95Y, E106G, H107Q, I145M, F175I) | SHHWGYGKHNGPEHWHKDFPIAKGERQSPVDIDTHTAKYDPSLKPLSVSYD QATSLRILNNGHVFNVEFDDSQDKAVLKGGPLDGTYRLIQFHYHWGSLDGQ GSGQTVDKKKYAAELHLVHWNTKYGDFGKAVQQPDGLAVLGMFLKVGS AKPGLQKVVDVLDSIKTKGKSADITNFDPRGLLPESLDYWTYPGSLTTPPLL ECVTWIVLKEPISVSSEQVLKFRKLNFNGEGEPEELMVDNWRPAQPLKNRQI KASFK | 5877 | 5878 |
| LibC000186 | CA2 (aa 2-260 of WT, L197P) | SHHWGYGKHNGPEHWHKDFPIAKGERQSPVDIDTHTAKYDPSLKPLSVSYD QATSLRILNNGHAFNVEFDDSQDKAVLKGGPLDGTYRLIQFHFHWGSLDGQ GSEHTVDKKKYAAELHLVHWNTKYGDFGKAVQQPDGLAVLGIFLKVGSA KPGLQKVVDVLDSIKTKGKSADFTNFDPRGLLPESLDYWTYPGSPTTPPLLE CVTWIVLKEPISVSSEQVLKFRKLNFNGEGEPEELMVDNWRPAQPLKNRQIK ASFK | 5879 | 5880 |
| — | CA2 (aa 2-260 of WT, G63D, E69V, N231I) | SHHWGYGKHNGPEHWHKDFPIAKGERQSPVDIDTHTAKYDPSLKPLSVSYD QATSLRILNNDHAFNVVFDDSQDKAVLKGGPLDGTYRLIQFHFHWGSLDGQ GSEHTVDKKKYAAELHLVHWNTKYGDFGKAVQQPDGLAVLGIFLKVGSA KPGLQKVVDVLDSIKTKGKSADFTNFDPRGLLPESLDYWTYPGSLTTPPLLE CVTWIVLKEPISVSSEQVLKFRKLNFIGEGEPEELMVDNWRPAQPLKNRQIK ASFK | 5881 | 5882 |

In some embodiments, the CA2 DDs described herein may include any of the sequences provided in Table 3. In Table 3 "*" represents the translation of stop codon. When the amino acid sequence in Table 3 contains one or more stop codons, the "AA SEQ ID NO." column provides the SEQ ID NO. of the individual components preceding and following the stop codon in the order in which they occur in the amino acid sequence.

TABLE 3

| | CA2 DDs | | |
|---|---|---|---|
| Library ID | Description | AA SEQUENCE | AA SEQ ID NO. | NA SEQ ID NO. |
| LibC000223 | CA2 (aa 2-260 of WT, G12E, A38V, A65V, G98V, S99H, D101M, G102D, Q103K, G104V, S105Q, E106S, H107I, T108L, V109W, D110I, K112R, K113N, Y114M, A115L, A116Q, E117N, L118F, H119T, L120W, V121F, H122T, W123G, N124T, T125P, K126N, Y127M, D129I, F130L, K132R, A133L, V134C, Q135S, Q136N, P137L, D138M, G139D, L140W, A141P, V142F, L143*, G144V, I145F, L156Q, V162A) | SHHWGYGKHNPEHWHKDFPIAKGERQSPVDID THTVKYDPSLKPLSVSYDQATSLRILNNGHVFNV EFDDSQDKAVLKGGPLDGTYRLIQFHFHWVHL MDKVQSILWIIKRNMLQNFTWFTGTPNMGILGEL CSNLMDWPF*VFFLKVGSAKPGQQKVVDALDSI KTKGKSADFTNFDPRGLLPESLDYWTYPGSLTTP PLLECVTWIVLKEPISVSSEQVLKFRKLNFNGEG EPEELMVDNWRPAQPLKNRQIKASFK | 5883; 5884 | 5885 |
| LibC000185 | CA2 (aa 2-260 of WT, F20L, K45N, G104R, A116V, A173G, W191*) | SHHWGYGKHNGPEHWHKDLPIAKGERQSPVDI DTHTAKYDPSLNPLSVSYDQATSLRILNNGHAFN VEFDDSQDKAVLKGGPLDGTYRLIQFHFHWGSL DGQRSEHTVDKKKYAVELHLVHWNTKYGDFG KAVQQPDGLAVLGIFLKVGSAKPGLQKVVDVL DSIKTKGKSGDFTNFDPRGLLPESLDY*TYPGSLT TPPLLECVTWIVLKEPISVSSEQVLKFRKLNFNGE GEPEELMVDNWRPAQPLKNRQIKASFK | 5886; 5887 | 5888 |
| LibC000215 | CA2 (aa 2-260 of WT, H17D, P30S, G81V, K132R, S151I, A152D, A173G, W191*) | SHHWGYGKHNGPEHWDKDFPIAKGERQSSVDI DTHTAKYDPSLKPLSVSYDQATSLRILNNGHAFN VEFDDSQDKAVLKVGPLDGTYRLIQFHFHWGSL DGQGSEHTVDKKKYAAELHLVHWNTKYGDFG RAVQQPDGLAVLGIFLKVGIDKPGLQKVVDVLD SIKTKGKSGDFTNFDPRGLLPESLDY*TYPGSLTT PPLLECVTWIVLKEPISVSSEQVLKFRKLNFNGEG EPEELMVDNWRPAQPLKNRQIKASFK | 5889; 5887 | 5890 |
| LibC000191 | CA2 (aa 2-260 of WT, H17D, P30S, G81V, K132R, S151I, A152D, A173G, W191*) | SHHWGYGKHNGPEHWDKDFPIAKGERQSSVDI DTHTAKYDPSLKPLSVSYDQATSLRILNNGHAFN VEFDDSQDKAVLKVGPLDGTYRLIQFHFHWGSL DGQGSEHTVDKKKYAAELHLVHWNTKYGDFG RAVQQPDGLAVLGIFLKVGIDKPGLQKVVDVLD SIKTKGKSGDFTNFDPRGLLPESLDY*TYPGSLTT PPLLECVTWIVLKEPISVSSEQVLKFRKLNFNGEG EPEELMVDNWRPAQPLKNRQIKASFK | 5889; 5887 | 5891 |
| LibC000200 | CA2 (aa 2-260 of WT, I59N, L90*, G102R) | SHHWGYGKHNGPEHWHKDFPIAKGERQSPVDI DTHTAKYDPSLKPLSVSYDQATSLRNLNNGHAF NVEFDDSQDKAVLKGGPLDGTYR*IQFHFHWGS LDRQGSEHTVDKKKYAAELHLVHWNTKYGDFG KAVQQPDGLAVLGIFLKVGSAKPGLQKVVDVL | 5892; 5893 | 5894 |

TABLE 3-continued

CA2 DDs

| Library ID | Description | AA SEQUENCE | AA SEQ ID NO. | NA SEQ ID NO. |
|---|---|---|---|---|
| LibC000197 | CA2 (aa 2-260 of WT, T35I, Y114H, P154L, D161V, P200A, Q221R, F225L, E233D, W244*) | DSIKTKGKSADFTNFDPRGLLPESLDYWTYPGSL TTPPLLECVTWIVLKEPISVSSEQVLKFRKLNFNG EGEPEELMVDNWRPAQPLKNRQIKASFK SHHWGYGKHNGPEHWHKDFPIAKGERQSPVDI DIHTAKYDPSLKPLSVSYDQATSLRILNNGHAFN VEFDDSQDKAVLKGGPLDGTYRLIQPHFHWGSL DGQGSEHTVDKKKHAAELHLVHWNTKYGDFG KAVQQPDGLAVLGIFLKVGSAKLGLQKVVVL DSIKTKGKSADFTNFDPRGLLPESLDYWTYPGSL TTAPLLECVTWIVLKEPISVSSERVLKLRKLNFN GDGEPEELMVDN*RPAQPLKNRQIKASFK | 5895; 5896 | 5897 |
| LibC000195 | CA2 (aa 2-260 of WT, S105L, L140V, G155C, Y190*) | SHHWGYGKHNGPEHWHKDFPIAKGERQSPVDI DTHTAKYDPSLKPLSVSYDQATSLRILNNGHAFN VEFDDSQDKAVLKGGPLDGTYRLIQPHFHWGSL DGQGLEHTVDKKKYAAELHLVHWNTKYGDFG KAVQQPDGVAVLGIFLKVGSAKPCLQKVVDVL DSIKTKGKSADFTNFDPRGLLPESLD*WTYPGSL TTPPLLECVTWIVLKEPISVSSEQVLKFRKLNFNG EGEPEELMVDNWRPAQPLKNRQIKASFK | 5898; 5899 | 5900 |
| LibC000188 | CA2 (aa 2-260 of WT, T35I, Y114H, P154L, D161V, P200A, F225L, E233D, W244*) | SHHWGYGKHNGPEHWHKDFPIAKGERQSPVDI DIHTAKYDPSLKPLSVSYDQATSLRILNNGHAFN VEFDDSQDKAVLKGGPLDGTYRLIQPHFHWGSL DGQGSEHTVDKKKHAAELHLVHWNTKYGDFG KAVQQPDGLAVLGIFLKVGSAKLGLQKVVVVL DSIKTKGKSADFTNFDPRGLLPESLDYWTYPGSL TTAPLLECVTWIVLKEPISVSSEQVLKLRKLNFN GDGEPEELMVDN*RPAQPLKNRQIKASFK | 5901; 5896 | 5902 |
| LibC000180 | CA2 (aa 2-260 of WT, K167*, R181H, E213*, V217L, L228H) | SHHWGYGKHNGPEHWHKDFPIAKGERQSPVDI DTHTAKYDPSLKPLSVSYDQATSLRILNNGHAFN VEFDDSQDKAVLKGGPLDGTYRLIQPHFHWGSL DGQGSEHTVDKKKYAAELHLVHWNTKYGDFG KAVQQPDGLAVLGIFLKVGSAKPGLQKVVDVL DSI*TKGKSADFTNFDPHGLLPESLLDYWTYPGSL TTPPLLECVTWIVLK*PISLSSEQVLKFRKHNFNG EGEPEELMVDNWRPAQPLKNRQIKASFK | 5903; 5904; 5905 | 5906 |
| LibC000190 | CA2 (aa 2-259 of WT, K167*, R181H, P194Q, G195A, S196H, L197*, T198P, T199P, P200L, P201L, L202F, L203W, E204N, C205V, V206*, V207P, W208G, I209L, V210C, L211S, K212R, E213N, I215S, S216A, V217S, S218A, S219A,) | SHHWGYGKHNGPEHWHKDFPIAKGERQSPVDI DTHTAKYDPSLKPLSVSYDQATSLRILNNGHAFN VEFDDSQDKAVLKGGPLDGTYRLIQPHFHWGSL DGQGSEHTVDKKKYAAELHLVHWNTKYGDFG KAVQQPDGLAVLGIFLKVGSAKPGLQKVVDVL DSI*TKGKSADFTNFDPHGLLPESLDYWTYQAH* | 5903; 5907; 5908; 5909; 5910; 5911; | 5913 |

TABLE 3-continued

| Library ID | Description | AA SEQUENCE | AA SEQ ID NO. | NA SEQ ID NO. |
|---|---|---|---|---|
| | E220S, Q221R, V222C, L223*, K224N, F225S, R226V, K227N, N229T, F230S, N231M, E233R, G234L, E235N, E237K, E238N, L239*, M240W, V241W, D242T, N243T, W244G, R245A, P246Q, A247L, Q248S, P249H, L250*, K251R, N252T, R253G, Q254K, I255S, A257L, F259S) | PPLLFWNV*PGLCSRNPSASAASRC*NSVNLTSM GRLNPKN*WWTTGAQLSH*RTGKSKLPS | 5912 | |
| LibC000227 | CA2 (aa 2-259 of WT, P13H, E117*, G150S, L184F, P185L, E186N, S187P, L188W, D189I, Y190T, W191G, T192P, Y193T, P194Q, G195A, S196H, L197*, T198P, T199P, P200L, P201L, L202F, L203W, E204N, C205V, V206*, T207P, W208G, I209L, V210C, L211*, K212R, E213N, I215S, S216A, V217S, S218A, S219A, E220S, Q221R, V222C, L223*, K224N, F225S, R226V, K227N, N229T, F230S, N231M, E233R, G234V, E235N, E237K, E238N, L239*, M240W, V241W, D242T, N243T, W244G, R245A, P246Q, A247L, Q248S, P249H, L250*, K251R, N252T, R253G, Q254K, I255S, A257L, F259S) | SHHWGYGKHNGHEHWHKDFPIAKGERQSPVDI DTHTAKYDPSLKPLSVSYDQATSLRILNNGHAFN VEFDDSQDKAVLKGGPLDGTYRLIQPHFHWGSL DGQGSEHTVDKKKYAA*LHLVHWNTKYGDFG KAVQQPDGLAVLGIFLKVSSAKPGLQKVVDVLD SIKTKGKSADFTNFDDPRGLFLNPWITGPTQAH*PP LLFWNV*PGLC*RNPSASAASRC*NSVNLTSMGR VNPKN*WWTTGAQLSH*RTGKSKLPS | 5914; 5915; 5908; 5916; 5917; 5918; 5911; 5912 | 5919 |
| LibC000218 | CA2 (aa 2-260 of WT, A133T, L147F, K148E, V149G, G150W, S151Q, A152R, K153*, L156P, Q157S, K158E, V159S, V160C, D161*, V162C, L163A, D164G, S165P, I166H, K167*, T168N, K171Q, S172E, A173C, D174*, P175L, T176H, N177*, F178L, D179R, P180S, R181S, G182W, L183P, L184P, P185S, E186*, S187I, L188P, D189G, Y190L, W191L, T192D, Y193L, G195R, S196L, L197T, T198D, T199H, P201S, L202S, L203S, E204G, C205M, V206C, T207D, W208L, I209D, V210C, L211A, K212Q, E213G, P214T, I215H, S216Q, V217R, S218Q, S219Q, E220R, Q221A, V222G, L223V, K224E, F225I, R226P, K227*, L228T, N229*, N231Q, G232W, E233R, E235*, F236T, E237R, E238R, L239T, M240D, V241G, D242G, N243Q, W244L, R245A, A247S, Q248S, P249A, | SHHWGYGKHNGPEHWHKDFPIAKGERQSPVDI DTHTAKYDPSLKPLSVSYDQATSLRILNNGHAFN VEFDDSQDKAVLKGGPLDGTYRLIQPHFHWGSL DGQGSEHTVDKKKYAAELHLVHWNTKYGDFG KTVQQPDGLAVLGIFPEGWQR*TGPSESC*CAGF H*NKGQEC*LH*LRSSWPPS*IPGLLDLPRLTDHP SSSGMCDLDCAQGTHQRQQRAGVEIP*T*LQMG G*TRRTDGGQLAPSSATEEQANQSFLQ | 5920; 5921; 5922; 5923; LH; 5924; 5925; T; 5926; 5927 | 5928 |

TABLE 3-continued

| | | CA2 DDs | | |
| --- | --- | --- | --- | --- |
| Library ID | Description | AA SEQUENCE | AA SEQ ID NO. | NA SEQ ID NO. |
| LibC000216 | L250T, K251E, N252E, R253Q, Q254A, I255N, K256Q, A257S, S258F, F259L, K260Q)<br><br>CA2 (aa 2-260 of WT, F20L, K45N, G104R, A16V, L147F, K148E, V149G, G150W, S151Q, A152R, K153*, P154T, L156P, Q157S, K158E, V159S, V160C, D161*, V162C, L163A, D164G, S165F, I166H, K167*, T168N, K171Q, S172E, A173C, D174*, F175L, T176H, N177*, F178L, D179R, P180S, R181S, G182W, L183P, L184P, P185S, E186*, S187I, L188P, D189G, Y190L, W191L, T192D, Y193L, G195R, S196L, L197T, T198D, T199H, P201S, L202S, E204G, C205M, V206C, T207D, W208L, I209D, V210C, L211A, K212Q, E213G, P214T, I215H, S216Q, V217R, S218Q, S219Q, E220R, Q221A, V222G, L223I, A224E, F225I, R226P, K227*, L228T, N229*, F230L, N231Q, G232W, E233G, P236T, N231Q, G232W, E233G, P236T, E237R, E238R, L239T, M240D, V241G, D242G, N243Q, W244L, A245A, A247S, Q248S, P249A, L250T, K251E, N252E, R253Q, Q254A, I255N, K256Q, A257S, S258F, F259L, K260Q) | SHHWGYGKHNGPEHWHKDLPIAKGERQSPVDI<br>DTHTAKYDPSLNPLSVSYDQATSLRILNNGHAFN<br>VEFDDSQDKAVLKGGPLDGTYRLIQFHFHWGSL<br>DGQRSEHTVDKKKYAVELHLVHWNTKYGDFG<br>KAVQQPDGLAVLGIFFEGWQR*TGPSESC*CAGF<br>H*NKGQEC*LH*LRSSWPPS*IPGLLDLPRLTDHP<br>SSSGMCDLDCAQGTHQRQQRAGIEIP*T*LQWG<br>G*TRRTDGGQLAPSSATEEQANQSFLQ | 5929;<br>5921;<br>5922;<br>5923;<br>LH;<br>5924;<br>5930;<br>T;<br>5926;<br>5927 | 5931 |
| LibC000222 | CA2 (aa 2-259 of WT, N11K, G12D, P13L, E14N, H15T, W16G, H17I, K18R, D19T, F20S, I22L, A23P, K24R, G25E, E26S, R27A, Q28S, S29P, P30L, V31L, D32T, I33S, D34T, T35L, H36I, T37Q, A38P, K39S, Y40M, D41T, P42L, S43P, L44*, K45S, L47C, S48L, V49F, S50P, Y51M, D52I, Q53K, A54Q, T55L, S56P, L57*, R58G, I59S, L60S, N61T, N62M, G63V, H64M, A65L, F66S, N67T, V68W, E69S, F70L, D71M, D72T, S73L, Q74R, D75T, A77Q, V78C, L79S, K80R, G81E, G82D, L84W, D85M, G86A, T87L, Y88T, R89D, L90*, I91F, Q92S, H94T, H96T, W97G, G98V, S99H, D101M, G102D, Q103K, G104V, S105Q, E106S, H107I, T108L, V109W, D110I, K112R, K113N, Y114M, A115L, A116Q, E117N, L118F, H119T, | SHHWGYGKHKDLNTGIRTSPLPRESASPLLTSTLI<br>QPSMTLP*SPCLFPMIKQLP*GSSTMVMLSTWSL<br>MTLRTKQCSREDPWMALTD*FSFTFTGVHLMDK<br>VQSILWIKRNMLQNFTWFTGTPNMGILGKLCSN<br>LMDWPF*VFF*RLAALNRAFRKLLMCWIPLKQR<br>ARVLTSLTSILVASFVNPWITGPTQAH*PPLLFWN<br>V*PGLCSWNPSASASRC*NYVNLTSMGRVNPK<br>N*RWTTGALLSH*RTGKSKLPS | 5932;<br>5933;<br>5934;<br>5935;<br>VFF;<br>5936;<br>5908;<br>5937;<br>5938,<br>5939,<br>5912 | 5940 |

TABLE 3-continued

| CA2 DDs | | | | |
|---|---|---|---|---|
| Library ID | Description | AA SEQUENCE | AA SEQ ID NO. | NA SEQ ID NO. |
| | L120W, V121F, H122T, W123G, N124T,<br>T125P, K126N, Y127M, D129I, F130L,<br>A133L, V134C, Q135S, Q136N, P137L,<br>D138M, G139D, L140W, A141P, V142F,<br>L143*, G144V, I145F, L147*, K148R,<br>V149L, G150A, S151A, A152L, K153N,<br>P154R, G155A, L156F, Q157R, V159L,<br>V160L, D161M, V162C, L163W, D164I,<br>S165P, I166L, T168Q, K169R, G170A,<br>K171R, S172V, A173L, D174T, F175S,<br>T176L, N177T, F178S, D179I, P180L,<br>R181V, G182A, L183S, L184F, P185V,<br>E186N, S187P, L188W, D189I, Y190T,<br>W191G, T192P, Y193T, P194Q, G195A,<br>S196H, L197*, T198P, T199P, P200L,<br>P201L, L202F, L203W, E204N, C205V,<br>V206*, T207P, W208G, I209L, V210C,<br>L211S, K212W, E213N, I215S, S216A,<br>V217S, S218A, S219A, E220S, Q221R,<br>V222C, L223*, K224N, F225Y, R226V,<br>K227N, N229T, F230S, N231M, E233R,<br>G234V, E235N, E237K, E238N, L239*,<br>M240R, V241N, D242T, N243T, W244G,<br>R245A, P246L, A247L, Q248S, P249H,<br>L250*, K251R, N252T, R253G, Q254K,<br>I255S, A257L, S258P, F259S) | | | |

Additional CA2 destabilizing domains are provided in Table 4. CA2 destabilizing mutants provided in Table 4 are identified as described above, such as by structure guided mutagenesis or by combining single mutants.

TABLE 4

| | CA2 DDs | | |
| Description | AA Sequence | AA SEQ ID NO. | NA SEQ ID NO. |
| --- | --- | --- | --- |
| CA2 (M1del, E106D)-variant 1 | SHHWGYGKHNGPEHWHKDFPIAKGERQSPVDIDTHTAKYDPSLKPLSVSYDQ ATSLRILNNGHAFNVEFDDSQDKAVLKGGPLDGTYRLIQFHFHWGSLDGQGSD HTVDKKKYAAELHLVHWNTKYGDFGKAVQQPDGLAVLGIFLKVGSAKPGLQ KVVDVLDSIKTKGKSADFTNFDPRGLLPESLDYWTYPGSLTTPPLLECVTWIVL KEPISVSSEQVLKFRKLNFNGEGEPEELMVDNWRPAQPLKNRQIKASFK | 6094 | 6130 |
| CA2 (M1del, I59N, G102R)-variant 2 | SHHWGYGKHNGPEHWHKDFPIAKGERQSPVDIDTHTAKYDPSLKPLSVSYDQ ATSLRNLNNGHAFNVEFDDSQDKAVLKGGPLDGTYRLIQFHFHWGSLDRQGS EHTVDKKKYAAELHLVHWNTKYGDFGKAVQQPDGLAVLGIFLKVGSAKPGL QKVVDVLDSIKTKGKSADFTNFDPRGLLPESLDYWTYPGSLTTPPLLECVTWIV LKEPISVSSEQVLKFRKLNFNGEGEPEELMVDNWRPAQPLKNRQIKASFK | 6095 | 6131 |
| CA2 (M1del, L197P)-variant 1 | SHHWGYGKHNGPEHWHKDFPIAKGERQSPVDIDTHTAKYDPSLKPLSVSYDQ ATSLRILNNGHAFNVEFDDSQDKAVLKGGPLDGTYRLIQFHFHWGSLDGQGSE HTVDKKKYAAELHLVHWNTKYGDFGKAVQQPDGLAVLGIFLKVGSAKPGLQ KVVDVLDSIKTKGKSADFTNFDPRGLLPESLDYWTYPGSPTTPPLLECVTWIVL KEPISVSSEQVLKFRKLNFNGEGEPEELMVDNWRPAQPLKNRQIKASFK | 6096 | 6132 |
| CA2 (M1del, L156H, S172C, F178Y, E16D)-variant 1 | SHHWGYGKHNGPEHWHKDFPIAKGERQSPVDIDTHTAKYDPSLKPLSVSYDQ ATSLRILNNGHAFNVEFDDSQDKAVLKGGPLDGTYRLIQFHFHWGSLDGQGSE HTVDKKKYAAELHLVHWNTKYGDFGKAVQQPDGLAVLGIFLKVGSAKPGHQ KVVDVLDSIKTKGKCADFTNYDPRGLLPDSLDYWTYPGSLTTPPLLECVTWIV LKEPISVSSEQVLKFRKLNFNGEGEPEELMVDNWRPAQPLKNRQIKASFK | 6097 | 6133 |
| CA2 (M1del, L156H)-variant 2 | SHHWGYGKHNGPEHWHKDFPIAKGERQSPVDIDTHTAKYDPSLKPLSVSYDQ ATSLRILNNGHAFNVEFDDSQDKAVLKGGPLDGTYRLIQFHFHWGSLDGQGSE HTVDKKKYAAELHLVHWNTKYGDFGKAVQQPDGLAVLGIFLKVGSAKPGHQ KVVDVLDSIKTKGKSADFTNFDPRGLLPESLDYWTYPGSLTTPPLLECVTWIVL KEPISVSSEQVLKFRKLNFNGEGEPEELMVDNWRPAQPLKNRQIKASFK | 6098 | 6134 |
| CA2 (M1del, R27L, T87I, H122Y, N252D)-variant 1 | SHHWGYGKHNGPEHWHKDFPIAKGELQSPVDIDTHTAKYDPSLKPLSVSYDQ ATSLRILNNGHAFNVEFDDSQDKAVLKGGPLDGIYRLIQFHFHWGSLDGQGSE HTVDKKKYAAELHLVYWNTKYGDFGKAVQQPDGLAVLGIFLKVGSAKPGLQ KVVDVLDSIKTKGKSADFTNFDPRGLLPESLDYWTYPGSLTTPPLLECVTWIVL KEPISVSSEQVLKFRKLNFNGEGEPEELMVDNWRPAQPLKDRQIKASFK | 6099 | 6135 |
| CA2 (I59N)-variant 1 | SHHWGYGKHNGPEHWHKDFPIAKGERQSPVDIDTHTAKYDPSLKPLSVSYDQ ATSLRNLNNGHAFNVEFDDSQDKAVLKGGPLDGTYRLIQFHFHWGSLDGQGS EHTVDKKKYAAELHLVHWNTKYGDFGKAVQQPDGLAVLGIFLKVGSAKPGL QKVVDVLDSIKTKGKSADFTNFDPRGLLPESLDYWTYPGSLTTPPLLECVTWIV LKEPISVSSEQVLKFRKLNFNGEGEPEELMVDNWRPAQPLKNRQIKASFK | 6100 | 6136 |
| CA2 (G63D)-variant 1 | SHHWGYGKHNGPEHWHKDFPIAKGERQSPVDIDTHTAKYDPSLKPLSVSYDQ ATSLRILNNDHAFNVEFDDSQDKAVLKGGPLDGTYRLIQFHFHWGSLDGQGSE HTVDKKKYAAELHLVHWNTKYGDFGKAVQQPDGLAVLGIFLKVGSAKPGLQ KVVDVLDSIKTKGKSADFTNFDPRGLLPESLDYWTYPGSLTTPPLLECVTWIVL KEPISVSSEQVLKFRKLNFNGEGEPEELMVDNWRPAQPLKNRQIKASFK | 6101 | 6137 |
| CA2 (M1del, H122Y)-variant 1 | SHHWGYGKHNGPEHWHKDFPIAKGERQSPVDIDTHTAKYDPSLKPLSVSYDQ ATSLRILNNGHAFNVEFDDSQDKAVLKGGPLDGTYRLIQFHFHWGSLDGQGSE HTVDKKKYAAELHLVYWNTKYGDFGKAVQQPDGLAVLGIFLKVGSAKPGLQ KVVDVLDSIKTKGKSADFTNFDPRGLLPESLDYWTYPGSLTTPPLLECVTWIVL KEPISVSSEQVLKFRKLNFNGEGEPEELMVDNWRPAQPLKNRQIKASFK | 6102 | 6138 |
| CA2 (M1del, G63D, M240L)-variant 1 | SHHWGYGKHNGPEHWHKDFPIAKGERQSPVDIDTHTAKYDPSLKPLSVSYDQ ATSLRILNNDHAFNVEFDDSQDKAVLKGGPLDGTYRLIQFHFHWGSLDGQGSE HTVDKKKYAAELHLVHWNTKYGDFGKAVQQPDGLAVLGIFLKVGSAKPGLQ KVVDVLDSIKTKGKSADFTNFDPRGLLPESLDYWTYPGSLTTPPLLECVTWIVL KEPISVSSEQVLKFRKLNFNGEGEPEELLVDNWRPAQPLKNRQIKASFK | 6103 | 6139 |
| CA2 (M1del, A77I, P249F)-variant 1 | SHHWGYGKHNGPEHWHKDFPIAKGERQSPVDIDTHTAKYDPSLKPLSVSYDQ ATSLRILNNGHAFNVEFDDSQDKIVLKGGPLDGTYRLIQFHFHWGSLDGQGSE HTVDKKKYAAELHLVHWNTKYGDFGKAVQQPDGLAVLGIFLKVGSAKPGLQ KVVDVLDSIKTKGKSADFTNFDPRGLLPESLDYWTYPGSLTTPPLLECVTWIVL KEPISVSSEQVLKFRKLNFNGEGEPEELMVDNWRPAQPLKNRQIKASFK | 6104 | 6140 |
| CA2 (M1del, D71K, T192F)-variant 1 | SHHWGYGKHNGPEHWHKDFPIAKGERQSPVDIDTHTAKYDPSLKPLSVSYDQ ATSLRILNNGHAFNVEFKDSQDKAVLKGGPLDGTYRLIQFHFHWGSLDGQGSE HTVDKKKYAAELHLVHWNTKYGDFGKAVQQPDGLAVLGIFLKVGSAKPGLQ | 6105 | 6141 |

TABLE 4-continued

| | CA2 DDs | | |
|---|---|---|---|
| Description | AA Sequence | AA SEQ ID NO. | NA SEQ ID NO. |
| | KVVDVLDSIKTKGKSADFTNFDPRGLLPESLDYWFYPGSLTTPPLLECVTWIVL KEPISVSSEQVLKFRKLNFNGEGEPEELMVDNWRPAQPLKNRQIKASFK | | |
| CA2 (M1del, L156H) | SHHWGYGKHNGPEHWHKDFPIAKGERQSPVDIDTHTAKYDPSLKPLSVSYDQ ATSLRILNNGHAFNVEFDDSQDKAVLKGGPLDGTYRLIQFHFHWGSLDGQGSE HTVDKKKYAAELHLVHWNTKYGDFGKAVQQPDGLAVLGIFLKVGSAKPGHQ KVVDVLDSIKTKGKSADFTNFDPRGLLPESLDYWTYPGSLTTPPLLECVTWIVL KEPISVSSEQVLKFRKLNFNGEGEPEELMVDNWRPAQPLKNRQIKASFK | 6106 | 6142 |
| CA2 (M1del, R27L, H122Y)- variant 1 | SHHWGYGKHNGPEHWHKDFPIAKGELQSPVDIDTHTAKYDPSLKPLSVSYDQ ATSLRILNNGHAFNVEFDDSQDKAVLKGGPLDGTYRLIQFHFHWGSLDGQGSE HTVDKKKYAAELHLVYWNTKYGDFGKAVQQPDGLAVLGIFLKVGSAKPGLQ KVVDVLDSIKTKGKSADFTNFDPRGLLPESLDYWTYPGSLTTPPLLECVTWIVL KEPISVSSEQVLKFRKLNFNGEGEPEELMVDNWRPAQPLKNRQIKASFK | 6107 | 6143 |
| CA2 (M1del, T87I, H122Y)- variant 1 | SHHWGYGKHNGPEHWHKDFPIAKGERQSPVDIDTHTAKYDPSLKPLSVSYDQ ATSLRILNNGHAFNVEFDDSQDKAVLKGGPLDGIYRLIQFHFHWGSLDGQGSE HTVDKKKYAAELHLVYWNTKYGDFGKAVQQPDGLAVLGIFLKVGSAKPGLQ KVVDVLDSIKTKGKSADFTNFDPRGLLPESLDYWTYPGSLTTPPLLECVTWIVL KEPISVSSEQVLKFRKLNFNGEGEPEELMVDNWRPAQPLKNRQIKASFK | 6108 | 6144 |
| CA2 (M1del, H122Y, N252D)- variant 1 | SHHWGYGKHNGPEHWHKDFPIAKGERQSPVDIDTHTAKYDPSLKPLSVSYDQ ATSLRILNNGHAFNVEFDDSQDKAVLKGGPLDGTYRLIQFHFHWGSLDGQGSE HTVDKKKYAAELHLVYWNTKYGDFGKAVQQPDGLAVLGIFLKVGSAKPGLQ KVVDVLDSIKTKGKSADFTNFDPRGLLPESLDYWTYPGSLTTPPLLECVTWIVL KEPISVSSEQVLKFRKLNFNGEGEPEELMVDNWRPAQPLKDRQIKASFK | 6109 | 6145 |
| CA2 (M1del, D72F, V241F)- variant 1 | SHHWGYGKHNGPEHWHKDFPIAKGERQSPVDIDTHTAKYDPSLKPLSVSYDQ ATSLRILNNGHAFNVEFDFSQDKAVLKGGPLDGTYRLIQFHFHWGSLDGQGSE HTVDKKKYAAELHLVHWNTKYGDFGKAVQQPDGLAVLGIFLKVGSAKPGLQ KVVDVLDSIKTKGKSADFTNFDPRGLLPESLDYWTYPGSLTTPPLLECVTWIVL KEPISVSSEQVLKFRKLNFNGEGEPEELMFDNWRPAQPLKNRQIKASFK | 6110 | 6146 |
| CA2 (M1del, V241F, P249L)- variant 1 | SHHWGYGKHNGPEHWHKDFPIAKGERQSPVDIDTHTAKYDPSLKPLSVSYDQ ATSLRILNNGHAFNVEFDDSQDKAVLKGGPLDGTYRLIQFHFHWGSLDGQGSE HTVDKKKYAAELHLVHWNTKYGDFGKAVQQPDGLAVLGIFLKVGSAKPGLQ KVVDVLDSIKTKGKSADFTNFDPRGLLPESLDYWTYPGSLTTPPLLECVTWIVL KEPISVSSEQVLKFRKLNFNGEGEPEELMFDNWRPAQLLKNRQIKASFK | 6111 | 6147 |
| CA2 (M1del, D72F, P249L)- variant 1 | SHHWGYGKHNGPEHWHKDFPIAKGERQSPVDIDTHTAKYDPSLKPLSVSYDQ ATSLRILNNGHAFNVEFDFSQDKAVLKGGPLDGTYRLIQFHFHWGSLDGQGSE HTVDKKKYAAELHLVHWNTKYGDFGKAVQQPDGLAVLGIFLKVGSAKPGLQ KVVDVLDSIKTKGKSADFTNFDPRGLLPESLDYWTYPGSLTTPPLLECVTWIVL KEPISVSSEQVLKFRKLNFNGEGEPEELMVDNWRPAQLLKNRQIKASFK | 6112 | 6148 |
| CA2 (M1del, D71L, T87N)- variant 1 | SHHWGYGKHNGPEHWHKDFPIAKGERQSPVDIDTHTAKYDPSLKPLSVSYDQ ATSLRILNNGHAFNVEFLDSQDKAVLKGGPLDGNYRLIQFHFHWGSLDGQGSE HTVDKKKYAAELHLVHWNTKYGDFGKAVQQPDGLAVLGIFLKVGSAKPGLQ KVVDVLDSIKTKGKSADFTNFDPRGLLPESLDYWTYPGSLTTPPLLECVTWIVL KEPISVSSEQVLKFRKLNFNGEGEPEELMVDNWRPAQPLKNRQIKASFK | 6113 | 6149 |
| CA2 (M1del, D71L, L250R)- variant 1 | SHHWGYGKHNGPEHWHKDFPIAKGERQSPVDIDTHTAKYDPSLKPLSVSYDQ ATSLRILNNGHAFNVEFLDSQDKAVLKGGPLDGTYRLIQFHFHWGSLDGQGSE HTVDKKKYAAELHLVHWNTKYGDFGKAVQQPDGLAVLGIFLKVGSAKPGLQ KVVDVLDSIKTKGKSADFTNFDPRGLLPESLDYWTYPGSLTTPPLLECVTWIVL KEPISVSSEQVLKFRKLNFNGEGEPEELMVDNWRPAQPRKNRQIKASFK | 6114 | 6150 |
| CA2 (Y51T)- variant 1 | SHHWGYGKHNGPEHWHKDFPIAKGERQSPVDIDTHTAKYDPSLKPLSVSTDQ ATSLRILNNGHAFNVEFDDSQDKAVLKGGPLDGTYRLIQFHFHWGSLDGQGSE HTVDKKKYAAELHLVHWNTKYGDFGKAVQQPDGLAVLGIFLKVGSAKPGLQ KVVDVLDSIKTKGKSADFTNFDPRGLLPESLDYWTYPGSLTTPPLLECVTWIVL KEPISVSSEQVLKFRKLNFNGEGEPEELMVDNWRPAQPLKNRQIKASFK | 6115 | 6151 |
| CA2 (S73N, R89F)-variant 1 | SHHWGYGKHNGPEHWHKDFPIAKGERQSPVDIDTHTAKYDPSLKPLSVSYDQ ATSLRILNNGHAFNVEFDDNQDKAVLKGGPLDGTYFLIQFHFHWGSLDGQGSE HTVDKKKYAAELHLVHWNTKYGDFGKAVQQPDGLAVLGIFLKVGSAKPGLQ KVVDVLDSIKTKGKSADFTNFDPRGLLPESLDYWTYPGSLTTPPLLECVTWIVL KEPISVSSEQVLKFRKLNFNGEGEPEELMVDNWRPAQPLKNRQIKASFK | 6116 | 6152 |
| CA2 (D72F, P249F)-variant 1 | SHHWGYGKHNGPEHWHKDFPIAKGERQSPVDIDTHTAKYDPSLKPLSVSYDQ ATSLRILNNGHAFNVEFDFSQDKAVLKGGPLDGTYRLIQFHFHWGSLDGQGSE HTVDKKKYAAELHLVHWNTKYGDFGKAVQQPDGLAVLGIFLKVGSAKPGLQ KVVDVLDSIKTKGKSADFTNFDPRGLLPESLDYWTYPGSLTTPPLLECVTWIVL KEPISVSSEQVLKFRKLNFNGEGEPEELMVDNWRPAQFLKNRQIKASFK | 6117 | 6153 |

TABLE 4-continued

| | CA2 DDs | | |
| --- | --- | --- | --- |
| Description | AA Sequence | AA SEQ ID NO. | NA SEQ ID NO. |
| CA2 (T55K, G63N, Q248N)-variant 1 | SHHWGYGKHNGPEHWHKDFPIAKGERQSPVDIDTHTAKYDPSLKPLSVSYDQ AKSLRILNNNHAFNVEFDDSQDKAVLKGGPLDGTYRLIQFHFHWGSLDGQGSE HTVDKKKYAAELHLVHWNTKYGDFGKAVQQPDGLAVLGIFLKVGSAKPGLQ KVVDVLDSIKTKGKSADFTNFDPRGLLPESLDYWTYPGSLTTPPLLECVTWIVL KEPISVSSEQVLKFRKLNFNGEGEPEELMVDNWRPANPLKNRQIKASFK | 6118 | 6154 |
| CA2 (Y193I)-variant 1 | SHHWGYGKHNGPEHWHKDFPIAKGERQSPVDIDTHTAKYDPSLKPLSVSYDQ ATSLRILNNGHAFNVEFDDSQDKAVLKGGPLDGTYRLIQFHFHWGSLDGQGSE HTVDKKKYAAELHLVHWNTKYGDFGKAVQQPDGLAVLGIFLKVGSAKPGLQ KVVDVLDSIKTKGKSADFTNFDPRGLLPESLDYWTIPGSLTTPPLLECVTWIVL KEPISVSSEQVLKFRKLNFNGEGEPEELMVDNWRPAQPLKNRQIKASFK | 6119 | 6155 |
| CA2 (S56F)-variant 1 | SHHWGYGKHNGPEHWHKDFPIAKGERQSPVDIDTHTAKYDPSLKPLSVSYDQ ATFLRILNNGHAFNVEFDDSQDKAVLKGGPLDGTYRLIQFHFHWGSLDGQGSE HTVDKKKYAAELHLVHWNTKYGDFGKAVQQPDGLAVLGIFLKVGSAKPGLQ KVVDVLDSIKTKGKSADFTNFDPRGLLPESLDYWTYPGSLTTPPLLECVTWIVL KEPISVSSEQVLKFRKLNFNGEGEPEELMVDNWRPAQPLKNRQIKASFK | 6120 | 6156 |
| CA2 (S56F, D71S)-variant 1 | SHHWGYGKHNGPEHWHKDFPIAKGERQSPVDIDTHTAKYDPSLKPLSVSYDQ ATFLRILNNGHAFNVEFSDSQDKAVLKGGPLDGTYRLIQFHFHWGSLDGQGSE HTVDKKKYAAELHLVHWNTKYGDFGKAVQQPDGLAVLGIFLKVGSAKPGLQ KVVDVLDSIKTKGKSADFTNFDPRGLLPESLDYWTYPGSLTTPPLLECVTWIVL KEPISVSSEQVLKFRKLNFNGEGEPEELMVDNWRPAQPLKNRQIKASFK | 6121 | 6157 |
| CA2 (S73N, R89Y)-variant 1 | SHHWGYGKHNGPEHWHKDFPIAKGERQSPVDIDTHTAKYDPSLKPLSVSYDQ ATSLRILNNGHAFNVEFDDNQDKAVLKGGPLDGTYYLIQFHFHWGSLDGQGS EHTVDKKKYAAELHLVHWNTKYGDFGKAVQQPDGLAVLGIFLKVGSAKPGL QKVVDVLDSIKTKGKSADFTNFDPRGLLPESLDYWTYPGSLTTPPLLECVTWIV LKEPISVSSEQVLKFRKLNFNGEGEPEELMVDNWRPAQPLKNRQIKASFK | 6122 | 6158 |
| CA2 (V134F, L228F)-variant 1 | SHHWGYGKHNGPEHWHKDFPIAKGERQSPVDIDTHTAKYDPSLKPLSVSYDQ ATSLRILNNGHAFNVEFDDSQDKAVLKGGPLDGTYRLIQFHFHWGSLDGQGSE HTVDKKKYAAELHLVHWNTKYGDFGKAFQQPDGLAVLGIFLKVGSAKPGLQ KVVDVLDSIKTKGKSADFTNFDPRGLLPESLDYWTYPGSLTTPPLLECVTWIVL KEPISVSSEQVLKFRKFNFNGEGEPEELMVDNWRPAQPLKNRQIKASFK | 6123 | 6159 |
| CA2 (M1del, L156H, A256del, S257del, F258del, K259del)-variant 1 | SHHWGYGKHNGPEHWHKDFPIAKGERQSPVDIDTHTAKYDPSLKPLSVSYDQ ATSLRILNNGHAFNVEFDDSQDKAVLKGGPLDGTYRLIQFHFHWGSLDGQGSE HTVDKKKYAAELHLVHWNTKYGDFGKAVQQPDGLAVLGIFLKVGSAKPGHQ KVVDVLDSIKTKGKSADFTNFDPRGLLPESLDYWTYPGSLTTPPLLECVTWIVL KEPISVSSEQVLKFRKLNFNGEGEPEELMVDNWRPAQPLKNRQIK | 6124 | 6160 |
| CA2 (M1del, S2del, H3del, H4del, W5del, L156H)-variant 1 | GYGKHNGPEHWHKDFPIAKGERQSPVDIDTHTAKYDPSLKPLSVSYDQATSLR ILNNGHAFNVEFDDSQDKAVLKGGPLDGTYRLIQFHFHWGSLDGQGSEHTVD KKKYAAELHLVHWNTKYGDFGKAVQQPDGLAVLGIFLKVGSAKPGHQKVVD VLDSIKTKGKSADFTNFDPRGLLPESLDYWTYPGSLTTPPLLECVTWIVLKEPIS VSSEQVLKFRKLNFNGEGEPEELMVDNWRPAQPLKNRQIKASFK | 6125 | 6161 |
| CA2 (M1del, W5Y, L156H)-variant 1 | SHHYGYGKHNGPEHWHKDFPIAKGERQSPVDIDTHTAKYDPSLKPLSVSYDQ ATSLRILNNGHAFNVEFDDSQDKAVLKGGPLDGTYRLIQFHFHWGSLDGQGSE HTVDKKKYAAELHLVHWNTKYGDFGKAVQQPDGLAVLGIFLKVGSAKPGHQ KVVDVLDSIKTKGKSADFTNFDPRGLLPESLDYWTYPGSLTTPPLLECVTWIVL KEPISVSSEQVLKFRKLNFNGEGEPEELMVDNWRPAQPLKNRQIKASFK | 6126 | 6162 |
| CA2 (M1del, L156H, G234del, E235del, P236del)-variant 1 | SHHWGYGKHNGPEHWHKDFPIAKGERQSPVDIDTHTAKYDPSLKPLSVSYDQ ATSLRILNNGHAFNVEFDDSQDKAVLKGGPLDGTYRLIQFHFHWGSLDGQGSE HTVDKKKYAAELHLVHWNTKYGDFGKAVQQPDGLAVLGIFLKVGSAKPGHQ KVVDVLDSIKTKGKSADFTNFDPRGLLPESLDYWTYPGSLTTPPLLECVTWIVL KEPISVSSEQVLKFRKLNFNGEEELMVDNWRPAQPLKNRQIKASFK | 6127 | 6163 |
| CA2 (M1del, L156H, F225L)-variant 1 | SHHWGYGKHNGPEHWHKDFPIAKGERQSPVDIDTHTAKYDPSLKPLSVSYDQ ATSLRILNNGHAFNVEFDDSQDKAVLKGGPLDGTYRLIQFHFHWGSLDGQGSE HTVDKKKYAAELHLVHWNTKYGDFGKAVQQPDGLAVLGIFLKVGSAKPGHQ KVVDVLDSIKTKGKSADFTNFDPRGLLPESLDYWTYPGSLTTPPLLECVTWIVL KEPISVSSEQVLKLRKLNFNGEGEPEELMVDNWRPAQPLKNRQIKASFK | 6128 | 6164 |
| CA2 (M1del, D71N, D75N, D101N, L156H)-variant 1 | SHHWGYGKHNGPEHWHKDFPIAKGERQSPVDIDTHTAKYDPSLKPLSVSYDQ ATSLRILNNGHAFNVEFNDSQNKAVLKGGPLDGTYRLIQFHFHWGSLNGQGSE HTVDKKKYAAELHLVHWNTKYGDFGKAVQQPDGLAVLGIFLKVGSAKPGHQ KVVDVLDSIKTKGKSADFTNFDPRGLLPESLDYWTYPGSLTTPPLLECVTWIVL KEPISVSSEQVLKFRKLNFNGEGEPEELMVDNWRPAQPLKNRQIKASFK | 6129 | 6165 |

In some embodiments a region or a portion of the CA2 WT may be used as template for generating CA2 DDs. In some embodiments, the CA2 DDs may exclude the lysine at position 260 of SEQ ID NO. 5810. In some aspects, the CA2 regions may include but are not limited to those described in Table 5.

TABLE 5

CA2 regions

| Description | AA SEQUENCE | AA SEQ ID NO. | NA SEQ ID NO. |
|---|---|---|---|
| CA2 (aa 1-142 of WT) | MSHHWGYGKHNGPEHWHKDFPIAKGERQSPVDIDTHTAKYDPSLKPLSVSYDQATSLRILNNGHAFNVEFDDSQDKAVLKGGPLDGTYRLIQFHFHWGSLDGQGSEHTVDKKKYAAELHLVHWNTKYGDFGKAVQQPDGLAV | 5941 | — |
| CA2 (aa 2-142 of WT) | SHHWGYGKHNGPEHWHKDFPIAKGERQSPVDIDTHTAKYDPSLKPLSVSYDQATSLRILNNGHAFNVEFDDSQDKAVLKGGPLDGTYRLIQFHFHWGSLDGQGSEHTVDKKKYAAELHLVHWNTKYGDFGKAVQQPDGLAV | 5942 | — |
| CA2 (aa 1-190 of WT) | MSHHWGYGKHNGPEHWHKDFPIAKGERQSPVDIDTHTAKYDPSLKPLSVSYDQATSLRILNNGHAFNVEFDDSQDKAVLKGGPLDGTYRLIQFHFHWGSLDGQGSEHTVDKKKYAAELHLVHWNTKYGDFGKAVQQPDGLAVLGIFLKVGSAKPGLQKVVDVLDSIKTKGKSADFTNFDPRGLLPESLDY | 5943 | — |
| CA2 (aa 2-190 of WT) | SHHWGYGKHNGPEHWHKDFPIAKGERQSPVDIDTHTAKYDPSLKPLSVSYDQATSLRILNNGHAFNVEFDDSQDKAVLKGGPLDGTYRLIQFHFHWGSLDGQGSEHTVDKKKYAAELHLVHWNTKYGDFGKAVQQPDGLAVLGIFLKVGSAKPGLQKVVDVLDSIKTKGKSADFTNFDPRGLLPESLDY | 5944 | — |
| CA2 (aa 1-89 of WT) | MSHHWGYGKHNGPEHWHKDFPIAKGERQSPVDIDTHTAKYDPSLKPLSVSYDQATSLRILNNGHAFNVEFDDSQDKAVLKGGPLDGTYR | 5945 | — |
| CA2 (aa 2-89 of WT) | SHHWGYGKHNGPEHWHKDFPIAKGERQSPVDIDTHTAKYDPSLKPLSVSYDQATSLRILNNGHAFNVEFDDSQDKAVLKGGPLDGTYR | 5946 | — |
| CA2 (aa 1-243 of WT) | MSHHWGYGKHNGPEHWHKDFPIAKGERQSPVDIDTHTAKYDPSLKPLSVSYDQATSLRILNNGHAFNVEFDDSQDKAVLKGGPLDGTYRLIQFHFHWGSLDGQGSEHTVDKKKYAAELHLVHWNTKYGDFGKAVQQPDGLAVLGIFLKVGSAKPGLQKVVDVLDSIKTKGKSADFTNFDPRGLLPESLDYWTYPGSLTTPPLLECVTWIVLKEPISVSSEQVLKFRKLNFNGEGEPEELMVDN | 5947 | — |
| CA2 (aa 2-243 of WT) | SHHWGYGKHNGPEHWHKDFPIAKGERQSPVDIDTHTAKYDPSLKPLSVSYDQATSLRILNNGHAFNVEFDDSQDKAVLKGGPLDGTYRLIQFHFHWGSLDGQGSEHTVDKKKYAAELHLVHWNTKYGDFGKAVQQPDGLAVLGIFLKVGSAKPGLQKVVDVLDSIKTKGKSADFTNFDPRGLLPESLDYWTYPGSLTTPPLLECVTWIVLKEPISVSSEQVLKFRKLNFNGEGEPEELMVDN | 5948 | — |
| CA2 (aa 1-166 of WT) | MSHHWGYGKHNGPEHWHKDFPIAKGERQSPVDIDTHTAKYDPSLKPLSVSYDQATSLRILNNGHAFNVEFDDSQDKAVLKGGPLDGTYRLIQFHFHWGSLDGQGSEHTVDKKKYAAELHLVHWNTKYGDFGKAVQQPDGLAVLGIFLKVGSAKPGLQKVVDVLDSI | 5949 | — |
| CA2 (aa 2-166 of WT) | SHHWGYGKHNGPEHWHKDFPIAKGERQSPVDIDTHTAKYDPSLKPLSVSYDQATSLRILNNGHAFNVEFDDSQDKAVLKGGPLDGTYRLIQFHFHWGSLDGQGSEHTVDKKKYAAELHLVHWNTKYGDFGKAVQQPDGLAVLGIFLKVGSAKPGLQKVVDVLDSI | 5903 | 5950 |
| CA2 (aa 1-116 of WT) | MSHHWGYGKHNGPEHWHKDFPIAKGERQSPVDIDTHTAKYDPSLKPLSVSYDQATSLRILNNGHAFNVEFDDSQDKAVLKGGPLDGTYRLIQFHFHWGSLDGQGSEHTVDKKKYAA | 5951 | — |
| CA2 (aa 2-116 of WT) | SHHWGYGKHNGPEHWHKDFPIAKGERQSPVDIDTHTAKYDPSLKPLSVSYDQATSLRILNNGHAFNVEFDDSQDKAVLKGGPLDGTYRLIQFHFHWGSLDGQGSEHTVDKKKYAA | 5952 | — |
| CA2 (aa 1-152 of WT) | MSHHWGYGKHNGPEHWHKDFPIAKGERQSPVDIDTHTAKYDPSLKPLSVSYDQATSLRILNNGHAFNVEFDDSQDKAVLKGGPLDGTYRLIQFHFHWGSLDGQGSEHTVDKKKYAAELHLVHWNTKYGDFGKAVQQPDGLAVLGIFLKVGSA | 5953 | — |
| CA2 (aa 2-152 of WT) | SHHWGYGKHNGPEHWHKDFPIAKGERQSPVDIDTHTAKYDPSLKPLSVSYDQATSLRILNNGHAFNVEFDDSQDKAVLKGGPLDGTYRLIQFHFHWGSLDGQGSEHTVDKKKYAAELHLVHWNTKYGDFGKAVQQPDGLAVLGIFLKVGSA | 5954 | — |
| CA2 (aa 1-43 of WT) | MSHHWGYGKHNGPEHWHKDFPIAKGERQSPVDIDTHTAKYDPS | 5955 | — |
| CA2 (aa 2-43 of WT) | SHHWGYGKHNGPEHWHKDFPIAKGERQSPVDIDTHTAKYDPS | 5956 | — |

Any of the CA2 regions described herein may be utilized to generate CA2 DD. Table 6 provides CA2 DDs derived from CA2 regions.

TABLE 6

| CA2 DDs derived from CA2 regions | | | |
|---|---|---|---|
| Description | AA SEQUENCE | AA SEQ ID NO. | NA SEQ ID NO. |
| CA2 (aa 2-142 of WT, G12E, A38V, A65V, G98V, S99H, D101M, G102D, Q103K, G104V, S105Q, E106S, H107I, T108L, V109W, D110I, K112R, K113N, Y114M, A115L, A116Q, E117N, L118F, H119T, L120W, V121F, H122T, W123G, N124T, T125P, K126N, Y127M, D129I, F130L, K132E, A133L, V134C, Q135S, Q136N, P137L, D138M, G139D, L140W, A141P, V142F) | SHHWGYGKHNEPEHWHKDFPIAKGERQSPVDIDTHT VKYDPSLKPLSVSYDQATSLRILNNGHVFNVEFDDSQ DKAVLKGGPLDGTYRLIQFHFHWVHLMDKVQSILWI KRNMLQNFTWFTGTPNMGILGELCSNLMDWPF | 5883 | 5957 |
| CA2 (aa 2-190 of WT, F20L, K45N, G104R, A116V, A173G) | SHHWGYGKHNGPEHWHKDLPIAKGERQSPVDIDTHT AKYDPSLNPLSVSYDQATSLRILNNGHAFNVEFDDSQ DKAVLKGGPLDGTYRLIQFHFHWGSLDGQRSEHTVD KKKYAVELHLVHWNTKYGDFGKAVQQPDGLAVLGI FLKVGSAKPGLQKVVDVLDSIKTKGKSGDFTNFDPRG LLPESLDY | 5886 | 5958 |
| CA2 (aa 2-190 of WT, H17D, P30S, G81V, K132R, S151I, A152D, A173G) | SHHWGYGKHNGPEHWDKDFPIAKGERQSSVDIDTHT AKYDPSLKPLSVSYDQATSLRILNNGHAFNVEFDDSQ DKAVLKVGPLDGTYRLIQFHFHWGSLDGQGSEHTVD KKKYAAELHLVHWNTKYGDFGRAVQQPDGLAVLGI FLKVGIDKPGLQKVVDVLDSIKTKGKSGDFTNFDPRG LLPESLDY | 5889 | 5959 |
| CA2 (aa 2-89 of WT, I59N) | SHHWGYGKHNGPEHWHKDFPIAKGERQSPVDIDTHT AKYDPSLKPLSVSYDQATSLRNLNNGHAFNVEFDDS QDKAVLKGGPLDGTYR | 5892 | 5960 |
| CA2 (aa 2-243 of WT, T35I, Y114H, P154L, D161V, P200A, Q221R, F225L, E233D) | SHHWGYGKHNGPEHWHKDFPIAKGERQSPVDIDIHT AKYDPSLKPLSVSYDQATSLRILNNGHAFNVEFDDSQ DKAVLKGGPLDGTYRLIQFHFHWGSLDGQGSEHTVD KKKHAAELHLVHWNTKYGDFGKAVQQPDGLAVLGI FLKVGSAKLGLQKVVVVLDSIKTKGKSADFTNFDPRG LLPESLDYWTYPGSLTTAPLLECVTWIVLKEPISVSSE RVLKLRKLNFNGDGEPEELMVDN | 5895 | 5961 |
| CA2 (aa 2-189 of WT, S105L, L140V, G155C) | SHHWGYGKHNGPEHWHKDFPIAKGERQSPVDIDTHT AKYDPSLKPLSVSYDQATSLRILNNGHAFNVEFDDSQ DKAVLKGGPLDGTYRLIQFHFHWGSLDGQGLEHTVD KKKYAAELHLVHWNTKYGDFGKAVQQPDGVAVLGI FLKVGSAKPCLQKVVDVLDSIKTKGKSADFTNFDPRG LLPESLD | 5898 | 5962 |
| CA2 (aa 2-243 of WT, T35I, Y114H, P154L, D161V, P200A, F225L, E233D) | SHHWGYGKHNGPEHWHKDFPIAKGERQSPVDIDIHT AKYDPSLKPLSVSYDQATSLRILNNGHAFNVEFDDSQ DKAVLKGGPLDGTYRLIQFHFHWGSLDGQGSEHTVD KKKHAAELHLVHWNTKYGDFGKAVQQPDGLAVLGI FLKVGSAKLGLQKVVVVLDSIKTKGKSADFTNFDPRG LLPESLDYWTYPGSLTTAPLLECVTWIVLKEPISVSSE QVLKLRKLNFNGDGEPEELMVDN | 5901 | 5963 |
| CA2 (aa 2-116 of WT, P13H) | SHHWGYGKHNGHEHWHKDFPIAKGERQSPVDIDTHT AKYDPSLKPLSVSYDQATSLRILNNGHAFNVEFDDSQ DKAVLKGGPLDGTYRLIQFHFHWGSLDGQGSEHTVD KKKYAA | 5914 | 5964 |
| CA2 (aa 2-152 of WT, A133T, L147F, K148E, V149G, G150W, S151Q, A152R) | SHHWGYGKHNGPEHWHKDFPIAKGERQSPVDIDTHT AKYDPSLKPLSVSYDQATSLRILNNGHAFNVEFDDSQ DKAVLKGGPLDGTYRLIQFHFHWGSLDGQGSEHTVD KKKYAAELHLVHWNTKYGDFGKTVQQPDGLAVLGI FFEGWQR | 5920 | 5965 |
| CA2 (aa 2-152 of WT, F20L, K45N, G104R, A116V, L147F, K148E, V149G, G150W, S151Q, A152R) | SHHWGYGKHNGPEHWHKDLPIAKGERQSPVDIDTHT AKYDPSLNPLSVSYDQATSLRILNNGHAFNVEFDDSQ DKAVLKGGPLDGTYRLIQFHFHWGSLDGQRSEHTVD KKKYAVELHLVHWNTKYGDFGKAVQQPDGLAVLGI FFEGWQR | 5929 | 5966 |

TABLE 6-continued

| | | | |
|---|---|---|---|
| CA2 DDs derived from CA2 regions | | | |
| Description | AA SEQUENCE | AA SEQ ID NO. | NA SEQ ID NO. |
| CA2 (aa 2-43 of WT, N11K, G12D, P13L, E14N, H15T, W16G, H17I, K18R, D19T, F20S, I22L, A23P, K24R, G25E, E26S, R27A, Q28S, S29P, P30L, V31L, D32T, I33S, D34T, T35L, H36I, T37Q, A38P, K39S, Y40M, D41T, P42L, S43P) | SHHWGYGKHKDLNTGIRTSPLPRESASPLLTSTLIQPS MTLP | 5932 | 5967 |

In some embodiments, DDs derived from CA2 may include one, two, three, four, five, or more of the mutations described in the previous Tables.

In some embodiments, a DD derived from CA2 comprises at least one mutation relative to the amino acid sequence of wildtype CA2, which mutation, in the absence of a stimulus, destabilizes the DD and at least one payload that is operably linked to the DD or an SRE comprising the DD. In the presence of the stimulus, the DD and the at least one payload are stabilized. In some embodiments, the DD derived from CA2 includes one, two, three, four or more mutations that, in the absence of the stimulus, destabilizes the DD and the at least one operably linked payload. In some embodiments, the destabilization ratio of a DD derived from CA2 comprising the at least one mutation is lower than the destabilization ratio of wildtype CA2. In some embodiments, the stabilization ratio of a DD derived from CA2 comprising the at least one mutation is higher than the stabilization ratio of wildtype CA2. In some embodiments, a DD may comprise one or more additional mutations that do not significantly affect the destabilization and stabilization ratios.

In some embodiments, the mutation may be a conserved (with similar physicochemical properties as the amino acid at the mutation site), a semi conserved (e.g., negatively to positively charge amino acid) or a non-conserved (amino acid with different physicochemical properties than the amino acid at the mutation site). In some embodiments, the amino acid lysine may be mutated to glutamic acid or arginine; the amino acid phenylalanine may be mutated to leucine; the amino acid leucine may be mutated to phenylalanine; or the amino acid asparagine may be mutated to serine. Regions or portions or domains of wild type proteins may be utilized as SREs/DDs in whole or in part. They may be combined or rearranged to create new peptides, proteins, regions or domains of which any may be used as SREs/DDs or the starting point for the design of further SREs and/or DDs.

The destabilization domains described herein may also include amino acid and nucleotide substitutions that do not affect stability, including conservative, non-conservative substitutions and or polymorphisms. In some embodiments, CA2 DDs described herein may also be fragments of the above destabilizing domains, including fragments containing variant amino acid sequences. Preferred fragments are unstable in the absence of the stimulus and stabilized upon addition of the stimulus. Preferred fragments retain the ability to interact with the stimulus with similar efficiency as the DDs described herein.

In one embodiment, the SRE comprises a region of the CA2 protein. The region of the CA2 protein may be 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260 or more than 260 amino acids in length. The region of the parent protein may be 5-50, 25-75, 50-100, 75-125, 100-150, 125-175, 150-200, 175-225, 200-250, 225-260 amino acids in length.

In some embodiments, the present disclosure provides a DD comprising a region of or the whole human carbonic anhydrase 2 (CA2; SEQ ID NO. 5810), and further comprising a mutation relative to SEQ ID NO. 5810 selected from A115L, A116Q, A116V, A133L, A133T, A141P, A152D, A152L, A152R, A173C, A173G, A173L, A173T, A23P, A247L, A247S, A257L, A257S, A38P, A38V, A54Q, A54V, A54X, A65L, A65N, A65V, A77I, A77P, A77Q, C205M, C205R, C205V, C205W, C205Y, D101G, D101M, D110I, D129I, D138G, D138M, D138N, D161*, D161M, D161V, D164G, D164I, D174*, D174T, D179E, D179I, D179R, D189G, D189I, D19T, D19V, D242G, D242T, D32T, D34T, D41T, D52I, D52L, D71F, D71G, D71K, D71M, D71S, D71Y, D72I, D72S, D72T, D72X, D75T, D75V, D85M, E106D, E106G, E106S, E117*, E117N, E14N, E186*, E186N, E204A, E204D, E204G, E204N, E213*, E213G, E213N, E220K, E220R, E220S, E233D, E233G, E233R, E235*, E235G, E235N, E237K, E237R, E238*, E238N, E238R, E26S, E69D, E69K, E69S, F130L, F146V, F175I, F175L, F175S, F178L, F178S, F20L, F20S, F225I, F225L, F225S, F225Y, F230I, F230L, F230S, F259L, F259S, F66S, F70I, F70L, F95Y, G102D, G104R, G104V, G128R, G12D, G12E, G131E, G131R, G131W, G139D, G144D, G144V, G150A, G150S, G150W, G155A, G155C, G155D, G155S, G170A, G170D, G182A, G182W, G195A, G195R, G232R, G232W, G234L, G234V, G25E, G63D, G63V, G81E, G81V, G82D, G86A, G86D, G98V, H107I, H107Q, H119T, H119Y, H122T, H122Y, H15L, H15T, H15Y, H17D, H17I, H36I, H36Q, H64M, H94T, H %

T, I145F, I145M, I166H, I166L, I209D, I209L, I215H, I215S, I22L, I255N, I255S, I33S, I59F, I59N, I59S, I91F, K111E, K111N, K112R, K113I, K113N, K126N, K132E, K132R, K148E, K148R, K153*, K153N, K158E, K158N, K167*, K169N, K169R, K171Q, K171R, K18R, K212N, K212Q, K212R, K212W, K224E, K224N, K227*, K227N, K24R, K251E, K251R, K256Q, K260F, K260L, K260Q, K39S, K45N, K45S, K80M, K80R, L118F, L120W, L140V, L140W, L143*, L147*, L147F, L156F, L156H, L156P, L156Q, L163A, L163W, L183P, L183S, L184F, L184P, L188P, L188W, L197*, L197M, L197P, L197R, L197T, L202F, L202H, L202I, L202P, L202R, L202S, L203P, L203S, L203W, L211*, L211A, L211S, L223*, L223I, L223V, L228F, L228H, L228T, L239*, L239F, L239T, L250*, L250P, L250T, L44*, L44M, L47C, L47V, L57*, L57X, L60S, L79F, L79S, L84W, L90*, L90V, M240D, M240L, M240R, M240W, N11D, N11K, N124T, N177*, N177T, N229*, N229T, N231D, N231F, N231K, N231L, N231M, N231Q, N23IT, N243Q, N243T, N252E, N252T, N61R, N61T, N61Y, N62K, N62M, N67D, N67T, P137L, P13A, P13H, P13L, P13S, P154L, P154R, P154T, P180L, P180S, P185L, P185S, P185V, P194Q, P200A, P200L, P200S, P200T, P201A, P201L, P201R, P201S, P214T, P236L, P236T, P246L, P246Q, P249A, P249F, P249H, P249I, P249X, P30L, P30S, P42L, P83A, Q103K, Q135S, Q136N, Q157R, Q157S, Q221A, Q221R, Q248F, Q248L, Q248S, Q254A, Q254K, Q28S, Q53H, Q53K, Q53N, Q74R, Q92H, Q92S, R181H, R181S, R181V, R226H, R226P, R226V, R245A, R253G, R253Q, R27A, R58G, R89D, R89F, R89I, R89X, R89Y, S105L, S105Q, S151A, S1511, S151Q, S165F, S165P, S172E, S172V, S187I, S187P, S196H, S196L, S216A, S216Q, S218A, S218Q, S219A, S219Q, S258F, S258P, S29C, S29P, S43P, S43T, S48L, S50P, S56F, S56N, S56P, S56X, S73L, S73N, S73X, S99H, T108L, T125I, T125P, T168K, T168N, T168Q, T176H, T176L, T192D, T192F, T192I, T192N, T192P, T192X, T198D, T198I, T198P, T199A, T199H, T199P, T207D, T207I, T207P, T207S, T35I, T35L, T37Q, T55L, T7L, V109M, V109W, V12IF, V134C, V134F, V142F, V149G, V149L, V159L, V159S, V160C, V160L, V162A, V162C, V206*, V206C, V206M, V210C, V217L, V217R, V217S, V222A, V222C, V222G, V241G, V241W, V241X, V31L, V49F, V68L, V68W, V78C, W123G, W123R, W16G, W191*, W191G, W191L, W208G, W208L, W208S, W244*, W244G, W244L, W97C, W97G, Y114H, Y114M, Y127M, Y190*, Y190L, Y190T, Y193C, Y193F, Y193I, Y193L, Y193T, Y193V, Y193X, Y40M, Y51F, Y51M, Y51T, Y51X, Y88T, K9N, and S29A. As used herein, "*" indicates the translation of the stop codon and "X" indicates any amino acid.

In some embodiments, the present disclosure provides a DD comprising a region of or the whole human carbonic anhydrase 2 (CA2; SEQ ID NO. 5810), and further comprising a mutation relative to SEQ ID NO. 5810 selected from E106D, G63D, H122Y, I59N, L156H, L183S, L197P, S56N, S56N, W208S, Y193I, and Y51T.

In some embodiments, the present disclosure provides a DD comprising a region of or the whole human carbonic anhydrase 2 (CA2; SEQ ID NO. 5810), and further comprising two or more mutations relative to SEQ ID NO. 5810. In some embodiments, a DD may comprise CA2 (aa 2-260 of WT, R27L, H122Y), CA2 (aa 2-260 of WT, T87I, H122Y), CA2 (aa 2-260 of WT, H122Y, N252D), CA2 (aa 2-260 of WT, D72F, V241F), CA2 (aa 2-260 of WT, D72F, P249L), CA2 (aa 2-260 of WT, D71L, L250R), CA2 (aa 2-260 of WT, D72F, P249F), CA2 (aa 2-260 of WT, T55K, G63N, Q248N), CA2

(aa 2-260 of WT, L156H, A257del, S258del, F259del, K260del), CA2 (aa 2-260 of WT, L156H, S2del, H3del, H4del, W5del), CA2 (aa 2-260 of WT, W4Y, L156H), CA2 (aa 2-260 of WT, L156H, G234del, E235del, P236del), CA2 (aa 2-260 of WT, L156H, F225L), CA2 (aa 2-260 of WT, D70N, D74N, D100N, L156H), (CA2 (a 2-260 of WT, I59N, G102R), CA2 (aa 2-260 of WT, G63D, E69V, N231I), CA2 (aa 2-260 of WT, R27L, T87I, H122Y, N252D), CA2 (aa 2-260 of WT, D72F, V241F, P249L), CA2 (aa 2-260 of WT, D71L, T87N, L250R), CA2 (aa 2-260 of WT, L156H, S172C, F178Y, E186D), CA2 (a 2-260 of WT, D71F, N231F), CA2 (aa 2-260 of WT, A77I, P249F), CA2 (aa 2-260 of WT, D71K, P249H), CA2 (aa 2-260 of WT, D72F, P249H), CA2 (aa 2-260 of WT, Q53N, N61Y), CA2 (aa 2-260 of WT, E106D, C205S), CA2 (aa 2-260 of WT, C205S, W208S), CA2 (aa 2-260 of WT, S73N, R89Y), CA2 (aa 2-260 of WT, D71K, T192F), CA2 (aa 2-260 of WT, Y193L, K260L), CA2 (aa 2-260 of WT, D71F, V241F, P249L), CA2 (a 2-260 of WT, L147F, Q248F), CA2 (aa 2-260 of WT, D52I, S258P), CA2 (a 2-260 of WT, D72S, T192N), CA2 (a 2-260 of WT, D179E, T192I), CA2 (aa 2-260 of WT, S56N, Q103K), CA2 (a 2-260 of WT, D71Y, Q248L), CA2 (a 2-260 of WT, S73N, R89F), CA2 (a 2-260 of WT, D71K, N231L, E235G, L239F), CA2 (aa 2-260 of WT, D72F, P249I), CA2 (aa 2-260 of WT, D72X, V241X, P249X), CA2 (aa 2-260 of WT, A54X, S56X, L57X, T192X), CA2 (aa 2-260 of WT, Y193V, K260F), CA2 (a 2-260 of WT, G63D, M240L), CA2 (a 2-260 of WT, V134F, L228F), CA2 (a 2-260 of WT, D71G, N231K), CA2 (a 2-260 of WT, S56F, D71S), CA2 (a 2-260 of WT, D52L, G128R, Q248F), CA2 (aa 2-260 of WT, S73X, R89X), CA2 (a 2-260 of WT, Y51X, D72X, V241X, P249X), CA2 (a 2-260 of WT, D72I, W97C), CA2 (aa 2-260 of WT, D71K, T192F, N231F), CA2 (aa 2-260 of WT, H36Q, S43T, Y51F, N67D, G131W, R226H), CA2 (a 2-260 of WT, F70I, F146V), CA2 (aa 2-260 of WT, K45N, V68L, H119Y, K169R, D179E), CA2 (aa 2-260 of WT, H15L, A54V, K111E, E220K, F225I), CA2 (aa 2-260 of WT, P3S, P83A, D101G, K111N, F230I), CA2 (aa 2-260 of WT, G63D, W123R, E220K), CA2 (aa 2-260 of WT, N11D, E69K, G86D, V109M, K113I, T125I, D138G, G155S), CA2 (aa 2-260 of WT, I59N, G102R, A173T), CA2 (aa 2-260 of WT, L79F, P180S), CA2 (a 2-260 of WT, A77P, G102R, D138N), CA2 (aa 2-260 of WT, F20L, K45N, G63D, E69V, N231I), CA2 (a 2-260 of WT, T199N, L202P, L228F), CA2 (aa 2-260 of WT, K9N, H122Y, T168K), CA2 (aa 2-260 of WT, Q53H, L90V, Q92H, G131E), CA2 (a 2-260 of WT, L44M, L47V, N62K, E69D), CA2 (a 2-260 of WT, D75V, K169N, F259L), CA2 (a 2-260 of WT, T207S, V222A, N231D), CA2 (aa 2-260 of WT, I59F, V206M, G232R), CA2 (aa 2-260 of WT, P13A, A133T), CA2 (aa 2-260 of WT, I59N, R89I), CA2 (aa 2-260 of WT, A65N, G86D, G131R, G155D, K158N, V162A, G170D, P236L), CA2 (aa 2-260 of WT, G12R, H15Y, D19V), CA2 (aa 2-260 of WT, A65V, F95Y, E106G, H107Q, I145M, F175I), CA2 (aa 2-260 of WT, G63D, E69V, N231I), CA2 (aa 2-260 of WT, S29A, C205S) and/or CA2 (aa 2-260 of WT, S29C, C205S). As used herein, "X" indicates any amino acid.

In some embodiments, a DD may comprise CA2 (aa 2-260 of WT, R27L, H122Y), CA2 (aa 2-260 of WT, T87I, H122Y), CA2 (aa 2-260 of WT, H122Y, N252D), CA2 (aa 2-260 of WT, D72F, V241F), CA2 (aa 2-260 of WT, V241F, P249L), CA2 (aa 2-260 of WT, D72F, P249L), CA2 (aa 2-260 of WT, D71L, L250R), CA2 (aa 2-260 of WT, D72F, P249F), CA2 (aa 2-260 of WT, T55K, G63N, Q248N), CA2 (aa 2-260 of WT, L156H, A257del, S258del, F259del, K260del), CA2 (aa 2-260 of WT, L156H, S2del, H3del, H4del, W5del), CA2 (aa 2-260 of WT, W4Y, L156H), CA2 (aa 2-260 of WT, L156H, G234del, E235del, P236del), CA2 (aa 2-260 of WT, L156H, F225L), CA2 (aa 2-260 of WT, D70N, D74N, D100N, L156H), (CA2 (aa 2-260 of WT, I59N, G102R), CA2 (aa 2-260 of WT, G63D, E69V, N231I), CA2 (aa 2-260 of WT, R27L, T87I, H122Y, N252D), CA2 (a 2-260 of WT, D72F, V241F, P249L), CA2 (a 2-260 of WT, D71L, T87N, L250R), CA2 (aa 2-260 of WT, L156H, S172C, F178Y, E186D), CA2 (aa 2-260 of WT, A77I, P249F), CA2 (aa 2-260 of WT, E106D, C205S), CA2 (aa 2-260 of WT, C205S, W208S), CA2 (aa 2-260 of WT, S73N, R89Y), CA2 (aa 2-260 of WT, D71K, T192F), CA2 (aa 2-260 of WT, S73N, R89F), CA2 (aa 2-260 of WT, G63D, M240L), CA2 (aa 2-260 of WT, V134F, L228F), and/or CA2 (aa 2-260 of WT, S56F, D71S).

In some embodiments, the CA2 may be derived from carbonic anhydrases of *Homo sapiens*. In some embodiments, the CA2 DDs described herein may have at least 40%, 45%, 50%, 55%, 60%, 65%, 70%, 75%, 80%, 85%, 90%, 91%, 92%, 93%, 94%, 95%, 96%, 97%, 98%, 99% but less than 100% sequence identity to a particular reference polynucleotide or polypeptide as determined by sequence alignment programs and parameters described herein and known to those skilled in the art. In some embodiments the reference polypeptide may be SEQ ID NO. 5810. -Tools for alignment may include those of the BLAST suite (Stephen F. Altschul, et al. (1997), "Gapped BLAST and PSI-BLAST: a new generation of protein database search programs", Nucleic Acids Res. 25:3389-3402).

In some embodiments, the CA2 DDs may be derived from carbonic anhydrases of species other than *Homo sapiens*. In some embodiments, the CA2 DDs may be derived from carbonic anhydrases of species such as but not limited to *Acinonyx jubatus, Ailuropoda melanoleuca, Balaenoptera acutorostrata scammoni, Callithrix jacchus, Callorhinus ursinus, Camelus bactrianus, Camelus dromedarius, Camelus ferus, Canis lupus dingo, Canis lupus familiaris, Carlito syricita, Castor canadensis, Cebus capucinus imitator, Ceratotherium simum simum, Cercocebus atys, Chinchilla lanigera, Chlorocebus sabaeus, Colobus angolensis palliatus, Delphinapterus leucas, Dipodomys ordii, Enhydra lutris kenyoni, Equus asinus, Equus caballus, Equus przewalskii, Erinaceus europaeus, Eumetopias jubatus, Felis catus, Galeopterus variegatus, Gorilla gorilla gorilla, Homo sapiens, Ictidomys tridecemlineatus, Jaculus jaculus, Lagenorhynchus obliquidens, Lemur catta, Leptonychotes weddellii, Lipotes vexillifer, Loxodonta africana, Macaca fascicularis, Macaca mulatta, Macaca nemestrina, Mandrillus leucophaeus, Manis javanica, Marmota flaviventris, Marmota marmota marmota, Microcebus murinus, Mus caroli, Mus musculus, Mus pahari, Mustela putorius furo, Nannospalax galili, Neomonachus schauinslandi, Neophocaena asiaeorientalis asiaeorientalis, Nomascus leucogenys, Odobenus rosmarus divergens, Orcinus orca, Oryctolagus cuniculus, Otolemur garnettii, Pan paniscus, Pan troglodytes, Panthera pardus, Panthera tigris altaica, Papio anubis, Physeter catodon, Piliocolobus tephrosceles, Pongo abelii, Propithecus coquereli, Puma concolor, Rhinopithecus bieti, Rhinopithecus roxellana, Saimiri boliviensis boliviensis, Sus scrofa, Theropithecus gelada, Trichechus manatus latirostris, Tupaia chinensis, Tursiops truncatus, Urocitellus parryii, Ursus arctos horribilis, Ursus maritimus, Vulpes vulpes,* and/or *Zalophus californianus.*

Stabilization and Destabilization Ratio of SRE

In some embodiments, the present disclosure provides methods for modulating protein, expression, function or level by measuring the stabilization ratio and destabilization ratio. As used herein, the stabilization ratio may be defined as the ratio of expression, function or level of a protein of interest in response to the stimulus to the expression, function or level of the protein of interest in the absence of the stimulus specific to the SRE. In some aspects, the stabilization ratio is at least 1, such as by at least 1-10, 1-20, 1-30, 1-40, 1-50, 1-60, 1-70, 1-80, 1-90, 1-100, 20-30, 20-40, 20-50, 20-60, 20-70, 20-80, 20-90, 20-95, 20-100, 3040, 30-50, 30-60, 30-70, 30-80, 30-90, 30-95, 30-100, 40-50, 40-60, 40-70, 40-80, 40-90, 40-95, 40-100, 50-60, 50-70, 50-80, 50-90, 50-95, 50-100, 60-70, 60-80, 60-90, 60-95, 60-100, 70-80, 70-90, 70-95, 70-100, 80-90, 80-95, 80-100, 90-95, 90-100 or 95-100. As used herein, the destabilization ratio may be defined as the ratio of expression, function or level of a protein of interest in the absence of the stimulus specific to the SRE to the expression, function or level of the protein of interest, that is expressed constitutively and in the absence of the stimulus specific to the SRE. As used herein "constitutively" refers to the expression, function or level of a protein of interest that is not linked to an SRE and is therefore expressed both in the presence and absence of the stimulus. In some aspects, the destabilization ratio is at least 0, such as by at least 0.1, 0.2, 0.3, 0.4, 0.5, 0.6, 0.7, 0.8, 0.9, or at least, 0-0.1, 0-0.2, 0-0.3, 0-0.4, 0-0.5, 0-0.6, 0-0.7, 0-0.8, 0-0.9, 0.1-0.2, 0.1-0.3, 0.1-0.4, 0.1-0.5, 0.1-0.6, 0.1-0.7, 0.1-0.8, 0.1-0.9, 0.2-0.3, 0.2-0.4, 0.2-0.5, 0.2-0.6, 0.2-0.7, 0.2-0.8, 0.2-0.9, 0.3-0.4, 0.3-0.5, 0.3-0.6, 0.3-0.7, 0.3-0.8, 0.3-0.9, 0.4-0.5, 0.4-0.6, 0.4-0.7, 0.4-0.8, 0.4-0.9, 0.5-0.6, 0.5-0.7, 0.5-0.8, 0.5-0.9, 0.6-0.7, 0.6-0.8, 0.6-0.9, 0.7-0.8, 0.7-0.9 or 0.8-0.9.

In some embodiments, the SRE of the effector module may stabilize the payload of interest by a stabilization ratio of 1 or more, wherein the stabilization ratio may comprise the ratio of expression, function or level of the payload of interest in the presence of the stimulus to the expression, function or level of the payload of interest in the absence of the stimulus.

In some embodiments, the SRE may destabilize the payload by a destabilization ratio between 0 and 0.09, wherein the destabilization ratio may comprise the ratio of expression, function or level of the payload of interest in the absence of the stimulus specific to the SRE to the expression, function or level of the payload of interest that is expressed constitutively, and in the absence of the stimulus specific to the SRE.

Payloads

As used herein a "payload" or "target payload" or "payload of interest (POI)" is defined as any protein or nucleic acid whose function is to be altered.

Payloads may include any coding or non-coding gene or any protein or fragment thereof.

Payloads are often associated with one or more SREs and may be encoded alone or in combination with one or more SRE in a polynucleotide of the disclosure. Payloads themselves may be altered (at the protein or nucleic acid level) thereby providing for an added layer of tenability of the effector module. For example, payloads may be engineered or designed to contain mutations, single or multiple, which affect the stability of the payload or its susceptibility to degradation, cleavage or trafficking. The combination of an SRE which can have a spectrum of responses to a stimulus with a payload which is altered to exhibit a variety of responses or gradations of output signals, e.g., expression levels, produce biocircuits which are superior to those in the art. The ability to independently tune both the SRE and the payload greatly increases the scope of uses of the effector modules of the present disclosure.

As used herein, the phrase "derived from" as it relates to effector modules, SRE's or payloads means that the effector module, SRE or payload originates at least in part from the stated parent molecule or sequence. For example, in designing an SRE, such SRE may be derived from an epitope or region of a naturally occurring protein but then have been modified in any of the ways taught herein to optimize the SRE function.

In one embodiment, the payload is derived from a region of parent protein or from a mutant protein. The region of the parent protein may be 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 195, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 302, 303, 304, 305, 306, 307, 308, 309, 310, 311, 312, 313, 314, 315, 316, 317, 318, 319, 320, 321, 322, 323, 324, 325, 326, 327, 328, 329, 330, 331, 332, 333, 334, 335, 336, 337, 338, 339, 340, 341, 342, 343, 344, 345, 346, 347, 348, 349, 350, 351, 352, 353, 354, 355, 356, 357, 358, 359, 360, 361, 362, 363, 364, 365, 366, 367, 368, 369, 370, 371, 372, 373, 374, 375, 376, 377, 378, 379, 380, 381, 382, 383, 384, 385, 386, 387, 388, 389, 390, 391, 392, 393, 394, 395, 396, 397, 398, 399, 400, 401, 402, 403, 404, 405, 406, 407, 408, 409, 410, 411, 412, 413, 414, 415, 416, 417, 418, 419, 420, 421, 422, 423, 424, 425, 426, 427, 428, 429, 430, 431, 432, 433, 434, 435, 436, 437, 438, 439, 440, 441, 442, 443, 444, 445, 446, 447, 448, 449, 450, or more than 450 amino acids in length. The region of the parent protein may be 5-50, 25-75, 50-100, 75-125, 100-150, 125-175, 150-200, 175-225, 200-250, 225-275, 250-300, 275-325, 300-350, 325-375, 350400, 375425, or 400-450 amino acids in length.

In one embodiment, the payload is derived from a region of parent protein or from a mutant protein and includes a region of the parent protein. The payload may include a region of the parent protein which is 1%, 5%, 10%, 15%, 20%, 25%, 30%, 35%, 40%, 45%, 50%, 55%, 60%, 65%, 70%, 75%, 80%, 85%, 90%, 95%, 99%, or 100%, 5-10%, 10-15%, 15-20%, 20-25%, 25-30%, 30-35%, 35-40%, 40-45%, 45-50%, 50-55%, 55-60%, 60-65%, 65-70%, 70-75%, 75-80%, 80-85%, 85-90%, 90-95%, 95-100%, 10-20%, 20-30%, 30-40%, 40-50%, 50-60%, 60-70%, 70-80%, 80-90%, 90-100%, 10-30%, 20-40%, 30-50%, 40-60%, 50-70%, 60-80%, 70-90%, 80-100%, 10-40%, 20-50%, 30-60%, 40-70%, 50-80%, 60-90%, 70-100%, 10-50%, 20-60%, 30-70%, 40-80%, 50-90%, 10-60%, 20-70%, 30-80%, 40-90%, 50-100%, 10-70%, 20-80%, 30-90%, 40-100%, 10-80%, 20-90%, 30-100%, 10-90%, 20-100%, 25-50%, 50-75%, or 75-100% of the parent protein or mutant protein.

In one embodiment, the payload is derived from a parent protein or from a mutant protein and may have 1%, 5%, 10%, 15%, 20%, 25%, 30%, 35%, 40%, 45%, 50%, 55%, 60%, 65%, 70%, 75%, 80%, 85%, 90%, 95%, 99%, or 100%, 5-10%, 10-15%, 15-20%, 20-25%, 25-30%, 30-35%, 35-40%, 40-45%, 45-50%, 50-55%, 55-60%, 60-65%, 65-70%, 70-75%, 75-80%, 80-85%, 85-90%, 90-95%, 95-100%, 10-20%, 20-30%, 30-40%, 40-50%, 50-60%, 60-70%, 70-80%, 80-90%, 90-100%, 10-30%, 20-40%, 30-50%, 40-60%, 50-70%, 60-80%, 70-90%, 80-100%, 10-40%, 20-50%, 30-60%, 40-70%, 50-80%, 60-90%, 70-100%, 10-50%, 20-60%, 30-70%, 40-80%, 50-90%, 60-100%, 10-60%, 20-70%, 30-80%, 40-90%, 50-100%, 10-70%, 20-80%, 30-90%, 40-100%, 10-80%, 20-90%, 30-100%, 10-90%, 20-100%, 25-50%, 50-75%, or 75-100% identity to the parent protein or mutant protein.

In one embodiment, the transmembrane domain region of a first payload may be replaced with a transmembrane domain, variant or fragment thereof, from a second parent protein.

Polypeptides and Polypeptides as Payloads

The stimuli, biocircuit components, effector modules, including their SREs and payloads of the present disclosure may exist as a whole polypeptide, a plurality of polypeptides or fragments of polypeptides, which independently may be encoded by one or more nucleic acids, a plurality of nucleic acids, fragments of nucleic acids or variants of any of the aforementioned.

As used herein, the term "polypeptide" refers to a polymer of amino acid residues (natural or unnatural) linked together most often by peptide bonds. The term, as used herein, refers to proteins, polypeptides, and peptides of any size, structure, or function. In some instances, the polypeptide encoded is smaller than about 50 amino acids and the polypeptide is then termed a peptide. If the polypeptide is a peptide, it will be at least about 2, 3, 4, or at least 5 amino acid residues long. Thus, polypeptides include gene products, naturally occurring polypeptides, synthetic polypeptides, homologs, orthologs, paralogs, fragments and other equivalents, variants, and analogs of the foregoing. A polypeptide may be a single molecule or may be a multi-molecular complex such as a dimer, trimer or tetramer. They may also comprise single chain or multichain polypeptides and may be associated or linked. The term polypeptide may also apply to amino acid polymers in which one or more amino acid residues are an artificial chemical analogue of a corresponding naturally occurring amino acid.

As used herein, the term "polypeptide variant" refers to molecules which differ in their amino acid sequence from a native or reference sequence. The amino acid sequence variants may possess substitutions, deletions, and/or insertions at certain positions within the amino acid sequence, as compared to a native or reference sequence. Ordinarily, variants will possess at least about 50% identity (homology) to a native or reference sequence, and preferably, they will be at least about 80%, more preferably at least about 90% identical (homologous) to a native or reference sequence.

In some embodiments "variant mimics" are provided. As used herein, the term "variant mimic" refers to a variant which contains one or more amino acids which would mimic an activated sequence. For example, glutamate may serve as a mimic for phospho-threonine and/or phospho-serine. Alternatively, variant mimics may result in deactivation or in an inactivated product containing the mimic, e.g., phenylalanine may act as an inactivating substitution for tyrosine;

or alanine may act as an inactivating substitution for serine. The amino acid sequences of the pharmaceutical compositions, biocircuits, biocircuit components, effector modules including their SREs or payloads of the disclosure may comprise naturally occurring amino acids and as such may be considered to be proteins, peptides, polypeptides, or fragments thereof. Alternatively, the pharmaceutical compositions, biocircuits, biocircuit components, effector modules including their SREs or payloads may comprise both naturally and non-naturally occurring amino acids.

As used herein, the term "amino acid sequence variant" refers to molecules with some differences in their amino acid sequences as compared to a native or starting sequence. The amino acid sequence variants may possess substitutions, deletions, and/or insertions at certain positions within the amino acid sequence. As used herein, the terms "native" or "starting" when referring to sequences are relative terms referring to an original molecule against which a comparison may be made. Native or starting sequences should not be confused with wild type sequences. Native sequences or molecules may represent the wild-type (that sequence found in nature) but do not have to be identical to the wild-type sequence.

Ordinarily, variants will possess at least about 70% homology to a native sequence, and preferably, they will be at least about 80%, more preferably at least about 90% homologous to a native sequence.

As used herein, the term "homology" as it applies to amino acid sequences is defined as the percentage of residues in the candidate amino acid sequence that are identical with the residues in the amino acid sequence of a second sequence after aligning the sequences and introducing gaps, if necessary, to achieve the maximum percent homology. Methods and computer programs for the alignment are well known in the art. It is understood that homology depends on a calculation of percent identity but may differ in value due to gaps and penalties introduced in the calculation.

As used herein, the term "homolog" as it applies to amino acid sequences is meant the corresponding sequence of other species having substantial identity to a second sequence of a second species.

As used herein, the term "analog" is meant to include polypeptide variants which differ by one or more amino acid alterations, e.g., substitutions, additions or deletions of amino acid residues that still maintain the properties of the parent polypeptide.

As used herein, the term "derivative" is used synonymously with the term "variant" and refers to a molecule that has been modified or changed in any way relative to a reference molecule or starting molecule.

The present disclosure contemplates several types of pharmaceutical compositions, biocircuits, biocircuit components, effector modules including their SREs or payloads which are amino acid based including variants and derivatives. These include substitutional, insertional, deletional and covalent variants and derivatives. As such, included within the scope of this disclosure are pharmaceutical compositions, biocircuits, biocircuit components, effector modules including their SREs or payloads comprising substitutions, insertions, additions, deletions and/or covalent modifications. For example, sequence tags or amino acids, such as one or more lysines, can be added to peptide sequences of the disclosure (e.g., at the N-terminal or C-terminal ends). Sequence tags can be used for peptide purification or localization. Lysines can be used to increase peptide solubility or to allow for biotinylation. Alternatively, amino acid residues located at the carboxy and amino terminal regions of the amino acid sequence of a peptide or protein may optionally be deleted providing for truncated sequences. Certain amino acids (e.g., C-terminal or N-terminal residues) may alternatively be deleted depending on the use of the sequence, as for example, expression of the sequence as part of a larger sequence which is soluble or linked to a solid support.

"Substitutional variants" when referring to proteins are those that have at least one amino acid residue in a native or starting sequence removed and a different amino acid inserted in its place at the same position. The substitutions may be single, where only one amino acid in the molecule has been substituted, or they may be multiple, where two or more amino acids have been substituted in the same molecule.

As used herein, the term "conservative amino acid substitution" refers to the substitution of an amino acid that is normally present in the sequence with a different amino acid of similar size, charge, or polarity. Examples of conservative substitutions include the substitution of a non-polar (hydrophobic) residue such as isoleucine, valine and leucine for another non-polar residue. Likewise, examples of conservative substitutions include the substitution of one polar (hydrophilic) residue for another such as between arginine and lysine, between glutamine and asparagine, and between glycine and serine. Additionally, the substitution of a basic residue such as lysine, arginine or histidine for another, or the substitution of one acidic residue such as aspartic acid or glutamic acid for another acidic residue are additional examples of conservative substitutions. Examples of non-conservative substitutions include the substitution of a non-polar (hydrophobic) amino acid residue such as isoleucine, valine, leucine, alanine, methionine for a polar (hydrophilic) residue such as cysteine, glutamine, glutamic acid or lysine and/or a polar residue for a non-polar residue.

As used herein, the term "insertional variants" when referring to proteins are those with one or more amino acids inserted immediately adjacent to an amino acid at a particular position in a native or starting sequence. As used herein, the term "immediately adjacent" refers to an adjacent amino acid that is connected to either the alpha-carboxy or alpha-amino functional group of a starting or reference amino acid.

As used herein, the term "deletional variants" when referring to proteins, are those with one or more amino acids in the native or starting amino acid sequence removed. Ordinarily, deletional variants will have one or more amino acids deleted in a particular region of the molecule.

As used herein, the term "derivatives," as referred to herein includes variants of a native or starting protein comprising one or more modifications with organic proteinaceous or non-proteinaceous derivatizing agents, and post-translational modifications. Covalent modifications are traditionally introduced by reacting targeted amino acid residues of the protein with an organic derivatizing agent that is capable of reacting with selected side-chains or terminal residues, or by harnessing mechanisms of post-translational modifications that function in selected recombinant host cells. The resultant covalent derivatives are useful in programs directed at identifying residues important for biological activity, for immunoassays, or for the preparation of anti-protein antibodies for immunoaffinity purification of the recombinant glycoprotein. Such modifications are within the ordinary skill in the art and are performed without undue experimentation.

As used herein, the terms "site," as it pertains to amino acid-based embodiments is used synonymously with "amino acid residue" and "amino acid side chain". A site represents a position within a peptide or polypeptide that may be modified, manipulated, altered, derivatized or varied within the polypeptide-based molecules of the present disclosure.

As used herein, the terms "termini" or "terminus," when referring to proteins refers to an extremity of a peptide or polypeptide. Such extremity is not limited only to the first or final site of the peptide or polypeptide but may include additional amino acids in the terminal regions. The polypeptide-based molecules of the present disclosure may be characterized as having both an N-terminus (terminated by an amino acid with a free amino group (NH2)) and a C-terminus (terminated by an amino acid with a free carboxyl group (COOH)).

Polypeptides or proteins of the disclosure are in some cases made up of multiple polypeptide chains brought together by disulfide bonds or by non-covalent forces (multimers, oligomers). These sorts of proteins will have multiple N- and C-termini. Alternatively, the termini of the polypeptides may be modified such that they begin or end, as the case may be, with a non-polypeptide-based moiety such as an organic conjugate.

Once any of the features have been identified or defined as a component of a biocircuit system component, stimulus, effector module including the SREs or payloads of the disclosure, any of several manipulations and/or modifications of these features may be performed by moving, swapping, inverting, deleting, randomizing or duplicating. Furthermore, it is understood that manipulation of features may result in the same outcome as a modification to the compositions of the disclosure. For example, a manipulation which involved deleting a domain would result in the alteration of the length of a molecule just as modification of a nucleic acid to encode less than a full-length molecule would.

Modifications and manipulations can be accomplished by methods known in the art such as site directed mutagenesis. The resulting modified molecules may then be tested for activity using in vitro or in vivo assays such as those described herein, or any other suitable screening assay known in the art.

In some embodiments, compositions of the present disclosure may comprise one or more atoms that are isotopes. As used herein, the term "isotope" refers to a chemical element that has one or more additional neutrons. In some embodiments, compounds of the present disclosure may be deuterated. As used herein, the term "deuterate" refers to the process of replacing one or more hydrogen atoms in a substance with deuterium isotopes. Deuterium isotopes are isotopes of hydrogen. The nucleus of hydrogen contains one proton while deuterium nuclei contain both a proton and a neutron. The pharmaceutical compositions, biocircuits, biocircuit components, effector modules including their SREs or payloads of the present disclosure may be deuterated in order to change one or more physical property, such as stability, or to allow pharmaceutical compositions, biocircuits, biocircuit components, effector modules including their SREs or payloads to be used in diagnostic and/or experimental applications.

At the protein level, any of the biocircuit components may comprise one or more post-translational modifications (PTM). Such PTMs may occur intracellularly after administration of a protein-based biocircuit component or upon or after translation of a biocircuit component administered as a nucleic acid encoding said biocircuit component.

Post translational modifications (PTMs) of the present disclosure include, but are not limited to acetylation, phosphorylation, ubiquitination, carboxylation, deamidation, deamination, deacetylation, dihydroxylation, dephosphorylation, formylation, gamma-carboxyglutamation, glutathionylation, glycation, hydroxylation, methylation, nitration, sumoylation, N- or O-transglutamination, glycosylation and farnesylation.

Effector modules, including their SREs and payloads, may independently have 1, 2, 3, 4, 5, 6, 7, 8, 9, 10 or more PTMs which are the same or different.

Effector modules may be designed to include one or more structural or functional domain, repeat, or motif of a protein family. Such domains, repeats and motifs are categorized by protein family; and representative families are given in the EMBL-EBI database, located at http://www.ebi.ac.uk/.

In some embodiments, protein modifications engineered into the structure of the compositions of the disclosure to interfere with antigen processing and peptide loading such as glycosylation and PEGylation, may also be useful in the present disclosure. Compositions of the disclosure may also be engineered to include non-classical amino acid sidechains to design less immunogenic compositions. Any of the methods discussed in International Patent Publication No. WO2005051975 for reducing immunogenicity may be useful in the present disclosure (the contents of which are incorporated by reference in their entirety).

The SRE may be, but is not limited to, a peptide, peptide complex, peptide-protein complex, protein, fusion protein, protein complex, protein-protein complex. The SRE may include one or more regions derived from any natural or mutated protein, or antibody. In this aspect, the SRE is an element, when responding to a stimulus, can tune intracellular localization, intramolecular activation, and/or degradation of payloads.

In some embodiments, effector modules of the present disclosure may comprise additional features that facilitate the expression and regulation of the effector module, such as one or more signal sequences (SSs), one or more cleavage and/or processing sites, one or more targeting and/or penetrating peptides, one or more tags, and/or one or more linkers. Additionally, effector modules of the present disclosure may further comprise other regulatory moieties such as inducible promoters, enhancer sequences, microRNA sites, and/or microRNA targeting sites. Each aspect or tuned modality may bring to the effector module or biocircuit a differentially tuned feature. For example, an SRE may represent a destabilizing domain, while mutations in the protein payload may alter its cleavage sites or dimerization properties or half-life and the inclusion of one or more microRNA or microRNA binding site may impart cellular detargeting or trafficking features. Consequently, the present disclosure embraces biocircuits which are multifactorial in their tenability. Such biocircuits may be engineered to contain one, two, three, four or more tuned features.

In some embodiments, effector modules of the present disclosure may include one or more degrons to tune expression. As used herein, a "degron" refers to a minimal sequence within a protein that is sufficient for the recognition and the degradation by the proteolytic system. An important property of degrons is that they are transferrable, that is, appending a degron to a sequence confers degradation upon the sequence. In some embodiments, the degron may be appended to the destabilizing domains, the payload or both. Incorporation of the degron within the effector module of the disclosure, confers additional protein instability to the effector module and may be used to minimize basal expression. In some embodiments, the degron may be an N degron, a phospho degron, a heat inducible degron, a photosensitive degron, an oxygen dependent degron. As a non-limiting example, the degron may be an Ornithine decarboxylase degron as described by Takeuchi et al. (Takeuchi J et al. (2008). Biochem J. 2008 Mar. 1; 410(2): 401-7; the contents of which are incorporated by reference in their entirety). Other examples of degrons useful in the present disclosure include degrons described in International patent publication Nos. WO2017004022, WO2016210343, and WO2011062%2; the contents of each of which are incorporated by reference in their entirety.

Immunotherapeutic Agents

In some embodiments, payloads of the present disclosure may be immunotherapeutic agents that induce immune responses in an organism. The immunotherapeutic agent may be a cytokine such as IL12 and fragments and variants thereof. In some embodiments, the immunotherapeutic agent may be membrane-bound IL12. In one embodiment, the immunotherapeutic agent induces an anti-cancer immune response in a cell, or in a subject.

In some embodiments, payloads of the present disclosure may comprise whole or a portion of membrane bound IL12 WT comprising the heterodimer IL-12A & IL12B separated by a linker. In some embodiments, the payload mbIL12 comprises a human IL12 subunit alpha or "IL-12A (p35)," or variants and mutants thereof. In some embodiments, the IL12 subunit alpha (p35) comprises the amino acid sequence of MWPPGSASQP PPSPAAATGL HPAARPVSLQ CRLSMCPARS LLLVATLVLL DHLSLARNLP-VATPDPGMFP CLHHSQNLLR AVSNMLQKAR QTLEFYPCTS EEIDHEDITK DKTSTVEACLPLELTK-NESC LNSRETSFIT NGSCLASRKT SFMMALCLSS IYEDLKMYQV EFKTMNAKLLMDPKRQIFLD QNM-LAVIDEL MQALNFNSET VPQKSSLEEP DFYKT-KIKLC ILLHAFRIRAVTIDRVMSYLNAS (SEQ ID NO. 1; WT human IL12A; NCBI Accession No. NP_000873.2). In some embodiments, the IL12 subunit alpha (p35) comprises amino acids 57-253 of SEQ ID NO: 1. In some embodiments, the IL12 subunit alpha (p35) comprises the amino acid sequence of RNLP-VATPDPGMFPCLHHSQNLL RAVSN MLQKAR-QTLEFYPCTSEEIDHEDITKDKTSTVEACLP LELTK-NESCLNSRETSFITNGSCLASRKTSFM MALCLSSIYEDLKMYQVEFKTMNAKLLMDPKRQI-FLDQNMLAVIDELMQALNFN-SETVPQKSSLEEPDFYKTKI KLCILLHAFRI-RAVTIDRVMSYLNAS (SEQ ID NO. 5777). In addition, the payload mbIL12 comprises a human Interleukin-12 subunit beta; IL12B, (p40), or variants and mutants thereof. In some embodiments, the IL12 subunit beta (p40) comprises the amino acid sequence of MCHQQLVISW FSLV-FLASPL VAIWELKKDV YVVELDWYPD APGEMVVLTC DTPEEDGITWTLDQSSEVLG SGKTL-TIQVK EFGDAGQYTC HKGGEVLSHS LLLLHKKEDG IWSTDILKDQKEPKNKTFLR CEAKNYSGRF TCWWLTTIST DLTFSVKSSR GSSDPQGVTC GAATL-SAERVRGDNKEYEYS VECQEDSACP AAEESLPIEV MVDAVHKLKY ENYTSSFFIR DIIKPDPPKNLQLKPLKNSR QVEVSWEYPD TWSTPHSYFS LTFCVQVQGK SKREKKDRVF TDKT-SATVICRKNASISVRA QDRYYSSSWS EWASVPCS (SEQ ID NO. 4; WT human IL12B; NCBI Reference Sequence: NP_002178.2). In some embodiments, the IL12 subunit beta (p40) comprises amino acids 23-328 of SEQ ID NO:4). In some embodiments, the IL12 subunit beta (p40) comprises the amino acid sequence of IWELKKDV YVVELDWYPD APGEMVVLTC DTPEEDGITW TLDQSSEVLG SGKTLTIQVK EFGDAGQYTC HKG-GEVLSHS LLLLHKKEDG IWSTDILKDQ KEPKNKT-FLR CEAKNYSGRF TCWWLTTIST DLTFSVKSSR GSSDPQGVTC GAATLSAERV RGDNKEYEYS VECQEDSACP AAEESLPIEV MVDAVHKLKY ENYTSSFFIR DIIKPDPPKN LQLKPLKNSR QVEVSWEYPD TWSTPHSYFS LTFCVQVQGK SKREKKDRVF TDKTSATVIC RKNASISVRA QDRYYSSSWS EWASVPCS (SEQ ID NO: 5763).

Cytokines and Co-Stimulatory Molecules

In some embodiments, payloads of the present disclosure may be cytokines, and fragments, variants, analogs and derivatives thereof, including but not limited to interleukins, tumor necrosis factors (TNFs), interferons (IFNs), TGF beta and chemokines. It is understood in the art that certain gene and/or protein nomenclature for the same gene or protein may be inclusive or exclusive of punctuation such as a dash "-" or symbolic such as Greek letters. Whether these are included or excluded herein, the meaning is not meant to be changed as would be understood by one of skill in the art. For example, IL12, IL 12 and IL-12 refer to the same interleukin.

In some embodiments, cytokines of the present disclosure may be utilized to improve expansion, survival, persistence, and potency of immune cells such as CD8+TEM, natural killer cells and tumor infiltrating lymphocytes (TIL) cells used for immunotherapy. In other embodiments, T cells engineered with two or more DD regulated cytokines are utilized to provide kinetic control of T cell activation and tumor microenvironment remodeling. In one aspect, the present disclosure provides biocircuits and compositions to minimize toxicity related to cytokine therapy. Despite its success in mitigating tumor burden, systemic cytokine therapy often results in the development of severe dose limiting side effects. Two factors contribute to the observed toxicity (a) Pleiotropism, wherein cytokines affect different cells types and sometimes produce opposing effects on the same cells depending on the context (b) Cytokines have short serum half-life and thus need to be administered at high doses to achieve therapeutic effects, which exacerbates the pleiotropic effects. In one aspect, cytokines of the present disclosure may be utilized to modulate cytokine expression in the event of adverse effects. In some embodiments, cytokines of the present disclosure may be designed to have prolonged life span or enhanced specificity to minimize toxicity.

In one embodiment, the payload of the disclosure may comprise IL12, for example, mbIL12. IL12 is a heterodimeric protein of two subunits (p35, p40) that is secreted by antigen presenting cells, such as macrophages and dendritic cells. Expression of IL12 requires the simultaneous expression of the two subunits to produce a biologically active heterodimer. In some embodiments, payloads of the disclosure may be p35 subunit or p40 subunit. IL12 is a type 1 cytokine that acts on natural killer (NK) cells, macrophages, CD8+ Cytotoxic T cells, and CD4+ T helper cells through STAT4 pathway to induce IFN-γ production in these effector immune cells (reviewed by Trinchieri G, Nat Rev Immunol. 2003; 3(2): 133-146). IL12 can promote the cytotoxic activity of NK cells and CD8+ T cells, and therefore has anti-tumor function as well as promotes T cell persistence in vivo. Intravenous injection of recombinant IL12 exhibited modest clinical efficacy in a handful of patients with advanced melanoma and renal cell carcinoma (Gollob et al., Clin. Cancer Res. 2000; 6(5):1678-1692). IL12 has been used as an adjuvant to enhance cytotoxic immunity using a melanoma antigen vaccine, or using peptide pulsed peripheral blood mononuclear cells; and to promote NK cell activity in breast cancer with trastuzumab treatment. Local delivery of IL12 to the tumor microenvironment promotes tumor regression in several tumor models. These studies all indicate that locally increased IL12 level can promote anti-tumor immunity. One major obstacle of systemic or local administration of recombinant IL12 protein, or through oncolytic viral vectors is the severe side effects when IL12 is presented at high level. Developing a system that tightly controls IL12 level may provide a safe use of IL12 in cancer treatment. A regulatable IL12 composition may also prevent negative feedback loops, thereby enhancing T cell effector functions.

In one aspect, the effector module of the disclosure may be a DD-IL12 fusion polypeptide. This regulatable DD-IL12 fusion polypeptide may be directly used as an immunothera-peutic agent or be transduced into an effector immune cell (T cells and TIL cells) to generate modified T cells with greater in vivo expansion and survival capabilities for adoptive cell transfer. The need for harsh preconditioning regimens in current adoptive cell therapies may be minimized using regulated IL12. DD-IL12 may be utilized to modify tumor microenvironment and increase persistence in solid tumors that are currently refractory to tumor antigen targeted therapy. In some embodiments, CAR expressing T cells may be armored with DD regulated IL12 to relieve immunosup-pression without systemic toxicity.

In some embodiments, the payloads may be but are not limited to IL12A (SEQ ID NO. 1-3), IL12B (SEQ ID NO.4) and their coding sequences i.e. SEQ ID NO. 7-9 and/or SEQ ID NO. 10 respectively.

In one embodiment, regulated cytokines may enable CAR-T in solid tumors to overcome stromal barriers by improving tumor homing, reducing immunosuppression, and reducing tumor promoting conditions. In one embodi-ment, regulated cytokines may enable CAR-T in solid tumors to overcome Antigen negative escape by promoting epitope spreading, antigen presenting cell trafficking, acti-vation and licensing. In one embodiment, regulated cytok-ines may enable CAR-T in solid tumors to overcome Anti-gen positive escape by improving expansion, increasing persistence, reducing exhaustion of T cells. In one embodi-ment, regulated cytokines enable local, on demand produc-tion of cytokines can safely improve efficacy. In one embodiment, regulated cytokines enable pulsatile produc-tion that can reduce feedback inhibition of cytokine signal-ing. In one embodiment, regulated cytokines can reduce senescence or exhaustion. In one embodiment, regulated cytokines enable on demand expression in a patient which may reduce any effect of cytokine on cell phenotype during product manufacturing.

Chimeric Antigen Receptors (CARs)

In some embodiments, biocircuits of the present disclo-sure may include chimeric antigen receptors (CARs) which when transduced into immune cells (e.g., T cells and NK cells), can re-direct the immune cells against the target (e.g., a tumor cell) which expresses a molecule recognized by the extracellular target moiety of the CAR.

As used herein, the term "chimeric antigen receptor (CAR)" refers to a synthetic receptor that mimics the TCR on the surface of T cells. In general, a CAR is composed of an extracellular targeting domain, a transmembrane domain/ region and an intracellular signaling/activation domain. In a standard CAR receptor, the components: the extracellular targeting domain, transmembrane domain and intracellular signaling/activation domain, are linearly constructed as a single fusion protein. The extracellular region comprises a targeting domain/moiety (e.g., a scFv) that recognizes a specific tumor antigen or other tumor cell-surface mol-ecules. The intracellular region may contain a signaling domain of TCR complex (e.g., the signal region of CD3Q, and/or one or more costimulatory signaling domains, such as those from CD28, 4-1BB (CD137) and OX-40 (CD134). For example, a "first-generation CAR" only has the CD3ζ signaling domain. In an effort to augment T-cell persistence and proliferation, costimulatory intracellular domains are added, giving rise to second generation CARs having a CD3ζ signal domain plus one costimulatory signaling domain, and third generation CARs having CD3ζ signal domain plus two or more costimulatory signaling domains. A CAR, when expressed by a T cell, endows the T cell with antigen specificity determined by the extracellular targeting moiety of the CAR. Recently, it is also desirable to add one or more elements such as homing and suicide genes to develop a more competent and safer architecture of CAR, so called the fourth-generation CAR.

In some embodiments, the immunotherapeutic agent of the effector module is a chimeric antigen receptor (CAR). The chimeric antigen may comprise an extracellular target moiety; a transmembrane domain; an intracellular signaling domain; and optionally, one or more co-stimulatory domains.

In some embodiments, the extracellular targeting domain is joined through the hinge (also called space domain or spacer) and transmembrane regions to an intracellular sig-naling domain. The hinge connects the extracellular target-ing domain to the transmembrane domain which transverses the cell membrane and connects to the intracellular signaling domain. The hinge may need to be varied to optimize the potency of CAR expressing cells toward cancer cells due to the size of the target protein where the targeting moiety binds, and the size and affinity of the targeting domain itself. Upon recognition and binding of the targeting moiety to the target cell, the intracellular signaling domain leads to an activation signal for the CAR T cell, which is further amplified by the "second signal" from one or more intrac-ellular costimulatory domains. The CAR T cell, once acti-vated, can destroy the target cell.

In some embodiments, the CAR of the present disclosure may be split into two parts, each part is linked to a dimeriz-ing domain, such that an input that triggers the dimerization promotes assembly of the intact functional receptor. Wu and Lim recently reported a split CAR in which the extracellular CD19 binding domain and the intracellular signaling ele-ment are separated and linked to the FKBP domain and the FRB* (T2089L mutant of FKBP-rapamycin binding) domain that heterodimerize in the presence of the rapamycin analog AP2167. The split receptor is assembled in the presence of AP2167 and together with the specific antigen binding, activates T cells (Wu et al., Science, 2015, 625 (6258): aab4077).

In some embodiments, the CAR of the present disclosure may be designed as an inducible CAR. Sakemura et al recently reported the incorporation of a Tet-On inducible system to the CD19 CAR construct. The CD19 CAR is activated only in the presence of doxycycline (Dox). Sake-mura reported that Tet-CD19 CAR T cells in the presence of Dox were equivalently cytotoxic against CD19+ cell lines and had equivalent cytokine production and proliferation upon CD19 stimulation, compared with conventional CD19CAR T cells (Sakemura et al., Cancer Immuno. Res., 2016, Jun. 21, Epub ahead of print). In one example, the biocircuit may include a Tet-CAR. In another example, a Tet-CAR may be the payload of the CA2 effector module under the control of SREs (e.g., CA2 DDs) described herein. The dual systems provide more flexibility to turn-on and off the CAR expression in transduced T cells.

According to the present disclosure, the CAR may be a first-generation CAR, or a second-generation CAR, or a third-generation CAR, or a fourth-generation CAR. In some embodiments, the payload of the present disclosure may be a full CAR construct composed of the extracellular domain, the hinge and transmembrane domain and the intracellular signaling region. In other embodiments, a component of the full CAR construct including an extracellular targeting moiety, a hinge region, a transmembrane domain, an intracellular signaling domain, one or more co-stimulatory domain, and other additional elements that improve CAR architecture and functionality including but not limited to a leader sequence, a homing element and a safety switch, or the combination of such components may be included in the biocircuits.

Extracellular Targeting Domain/Moiety

In accordance with the disclosure, the extracellular target moiety of a CAR may be any agent that recognizes and binds to a given target molecule, for example, a neoantigen on tumor cells, with high specificity and affinity. The target moiety may be an antibody and variants thereof that specifically binds to a target molecule on tumor cells, or a peptide aptamer selected from a random sequence pool based on its ability to bind to the target molecule on tumor cells, or a variant or fragment thereof that can bind to the target molecule on tumor cells, or an antigen recognition domain from native T-cell receptor (TCR) (e.g. CD4 extracellular domain to recognize HIV infected cells), or exotic recognition components such as a linked cytokine that leads to recognition of target cells bearing the cytokine receptor, or a natural ligand of a receptor.

In some embodiments, the targeting domain of a CAR may be a Ig NAR, a Fab fragment, a Fab' fragment, a F(ab)'2 fragment, a F(ab)'3 fragment, Fv, a single chain variable fragment (scFv), a bis-scFv, a (scFv)2, a minibody, a diabody, a tribody, a tetrabody, a disulfide stabilized Fv protein (dsFv), a unibody, a nanobody, or an antigen binding region derived from an antibody that specifically recognizes a target molecule, for example a tumor specific antigen (TSA). In one embodiment, the targeting moiety is a scFv. The scFv domain, when it is expressed on the surface of a CAR T cell and subsequently binds to a target protein on a cancer cell, is able to maintain the CAR T cell in proximity to the cancer cell and to trigger the activation of the T cell. A scFv can be generated using routine recombinant DNA technology techniques and is discussed in the present disclosure.

In one embodiment, the targeting moiety of the CAR may recognize CD19. CD19 is a well-known B cell surface molecule, which upon B cell receptor activation enhances B-cell antigen receptor induced signaling and expansion of B cell populations. CD19 is broadly expressed in both normal and neoplastic B cells. Malignancies derived from B cells such as chronic lymphocytic leukemia, acute lymphocytic leukemia and many non-Hodgkin lymphomas frequently retain CD19 expression. This near universal expression and specificity for a single cell lineage has made CD19 an attractive target for immunotherapies. Human CD19 has 14 exons wherein exon 1-4 encode the extracellular portion of the CD19, exon 5 encodes the transmembrane portion of CD19 and exons 6-14 encode the cytoplasmic tail. In one embodiment, the targeting moiety may comprise scFvs derived from the variable regions of the FMC63 antibody. FMC63 is an IgG2a mouse monoclonal antibody clone specific to the CD19 antigen that reacts with CD19 antigen on cells of the B lineage. The epitope of CD19 recognized by the FMC63 antibody is in exon 2 (Sotillo et al (2015) Cancer Discov; 5(12):1282-95; the contents of which are incorporated by reference in their entirety). In some embodiments, the targeting moiety of the CAR may be derived from the variable regions of other CD19 monoclonal antibody clones including but not limited to 4G7, SJ25C1, CVID3/429, CVID3/155, HIB19, and J3-119.

In one aspect, the extracellular target moiety may be an scFv derived from an antibody. In one aspect, the scFv may specifically bind to a CD19 antigen.

Intracellular Signaling Domains

The intracellular domain of a CAR fusion polypeptide, after binding to its target molecule, transmits a signal to the effector immune cell, activating at least one of the normal effector functions of effector immune cells, including cytolytic activity (e.g., cytokine secretion) or helper activity. Therefore, the intracellular domain comprises an "intracellular signaling domain" of a T cell receptor (TCR).

In some aspects, the entire intracellular signaling domain can be employed. In other aspects, a truncated portion of the intracellular signaling domain may be used in place of the intact chain as long as it transduces the effector function signal.

In some embodiments, the intracellular signaling domain of the present disclosure may contain signaling motifs which are known as immunoreceptor tyrosine-based activation motifs (ITAMs). Examples of ITAM containing cytoplasmic signaling sequences include those derived from TCR CD3zeta, FcR gamma, FcR beta, CD3 gamma, CD3 delta, CD3 epsilon, CD5, CD22, CD79a, CD79b, and CD66d. In one example, the intracellular signaling domain is a CD3 zeta (CD3ζ) signaling domain.

In some embodiments, the intracellular region of the present disclosure further comprises one or more costimulatory signaling domains which provide additional signals to the effector immune cells. These costimulatory signaling domains, in combination with the signaling domain can further improve expansion, activation, memory, persistence, and tumor-eradicating efficiency of CAR engineered immune cells (e.g., CAR T cells). In some cases, the costimulatory signaling region contains 1, 2, 3, or 4 cytoplasmic domains of one or more intracellular signaling and for costimulatory molecules. The costimulatory signaling domain may be the intracellular/cytoplasmic domain of a costimulatory molecule, including but not limited to CD2, CD7, CD27, CD28, 4-1BB (CD137), OX40 (CD134), CD30, CD40, ICOS (CD278), GITR (glucocorticoid-induced tumor necrosis factor receptor), LFA-1 (lymphocyte function-associated antigen-1), LIGHT, NKG2C, B7-H3. In one example, the costimulatory signaling domain is derived from the cytoplasmic domain of CD28. In another example, the costimulatory signaling domain is derived from the cytoplasmic domain of 4-1BB (CD137). In another example, the co-stimulatory signaling domain may be an intracellular domain of GITR as taught in U.S. Pat. No. 9,175,308; the contents of which are incorporated herein by reference in its entirety.

Transmembrane Domains and Hinge Regions

In some embodiments, the CAR of the present disclosure may comprise a transmembrane domain. As used herein, the term "Transmembrane domain (TM)" refers broadly to an amino acid sequence of about 15 residues in length which spans the plasma membrane. More preferably, a transmembrane domain includes at least 20, 21, 22, 23, 24, 25, 26, 27, 28, 29, 30, 31, 32, 33, 34, 35, 36, 37, 38, 39, 40, 41, 42, 43, 44, or 45 amino acid residues and spans the plasma membrane. In some embodiments, the transmembrane domain of the present disclosure may be derived either from a natural or from a synthetic source. The transmembrane domain of a CAR may be derived from any naturally membrane-bound or transmembrane protein. For example, the transmembrane region may be derived from (i.e. comprise at least the transmembrane region(s) of) the alpha, beta or zeta chain of the T-cell receptor, CD3 epsilon, CD4, CD5, CD8, CD8a, CD9, CD16, CD22, CD33, CD28, CD37, CD45, CD64, CD80, CD86, CD134, CD137, CD152, or CD154.

Alternatively, the transmembrane domain of the present disclosure may be synthetic. In some aspects, the synthetic sequence may comprise predominantly hydrophobic residues such as leucine and valine.

In some embodiments, the transmembrane domain of the present disclosure may be selected from the group consisting of a CD8α transmembrane domain, a CD4 transmembrane domain, a CD 28 transmembrane domain, a CTLA-4 transmembrane domain, a PD-1 transmembrane domain, and a human IgG4 Fc region. As non-limiting examples, the transmembrane domain may be a CTLA-4 transmembrane domain comprising the amino acid sequences of SEQ ID NOs. 1-5 of International Patent Publication NO. WO2014/100385; and a PD-1 transmembrane domain comprising the amino acid sequences of SEQ ID NOs. 6-8 of International Patent Publication NO. WO2014100385; the contents of each of which are incorporated herein by reference in their entirety.

In some embodiments, the CAR of the present disclosure may comprise an optional hinge region (also called spacer). A hinge sequence is a short sequence of amino acids that facilitates flexibility of the extracellular targeting domain that moves the target binding domain away from the effector cell surface to enable proper cell/cell contact, target binding and effector cell activation (Patel et al., Gene Therapy, 1999; 6: 412419). The hinge sequence may be positioned between the targeting moiety and the transmembrane domain.

In some embodiments, the CAR of the present disclosure may comprise one or more linkers between any of the domains of the CAR. The linker may be between 1-30 amino acids long.

In some embodiments, the components including the targeting moiety, transmembrane domain and intracellular signaling domains of the present invention may be constructed in a single fusion polypeptide.

In one embodiment, the CAR construct comprises a CD19 scFv (e.g., CAT13.1E10 or FMC63), a CD8α spacer or transmembrane domain, and a 4-1BB and CD3ζ endodomain. These constructs with CAT13.1E10 may have increased proliferation after stimulation in vitro, increased cytotoxicity against the CD19+ targets, and increased effector and target interactions as compared to constructs with FMC63.

In some embodiments, the payload of the disclosure may be any of the co-stimulatory molecules and/or intracellular domains described herein. In some embodiments, one or more co-stimulatory molecules, each under the control of different SRE may be used in the present disclosure. SRE regulated co-stimulatory molecules may also be expressed in conjunction with a first-generation CAR, a second-generation CAR, a third generation CAR, a fourth generation, or any other CAR design described herein.

Tandem CAR (TanCAR)

In some embodiments, the CAR of the present disclosure may be a tandem chimeric antigen receptor (TanCAR) which is able to target two, three, four, or more tumor specific antigens. In some aspects, the CAR is a bispecific TanCAR including two targeting domains which recognize two different TSAs on tumor cells. The bispecific CAR may be further defined as comprising an extracellular region comprising a targeting domain (e.g., an antigen recognition domain) specific for a first tumor antigen and a targeting domain (e.g., an antigen recognition domain) specific for a second tumor antigen. In other aspects, the CAR is a multispecific TanCAR that includes three or more targeting domains configured in a tandem arrangement. The space between the targeting domains in the TanCAR may be between about 5 and about 30 amino acids in length, for example, 6, 7, 8, 9, 10, 11, 12, 13, 14, 15, 16, 17, 18, 19, 20, 21, 22, 23, 24, 25, 26, 27, 28, 29 and 30 amino acids.

Split CAR

In some embodiments, the components including the targeting moiety, transmembrane domain and intracellular signaling domains of the present disclosure may be split into two or more parts such that it is dependent on multiple inputs that promote assembly of the intact functional receptor. In one embodiment, the split synthetic CAR system can be constructed in which the assembly of an activated CAR receptor is dependent on the binding of a ligand to the SRE (e.g. a small molecule) and a specific antigen to the targeting moiety. As a non-limiting example, the split CAR consists of two parts that assemble in a small molecule-dependent manner, one part of the receptor features an extracellular antigen binding domain (e.g. scFv) and the other part has the intracellular signaling domains, such as the CD3ζ intracellular domain.

In other aspects, the split parts of the CAR system can be further modified to increase signal. In one example, the second part of cytoplasmic fragment may be anchored to the plasma membrane by incorporating a transmembrane domain (e.g., CD8α transmembrane domain) to the construct. An additional extracellular domain may also be added to the second part of the CAR system, for instance an extracellular domain that mediates homo-dimerization. These modifications may increase receptor output activity, i.e., T cell activation.

In some aspects, the two parts of the split CAR system contain heterodimerization domains that conditionally interact upon binding of a heterodimerizing small molecule. As such, the receptor components are assembled in the presence of the small molecule, to form an intact system which can then be activated by antigen engagement. Any known heterodimerizing components can be incorporated into a split CAR system. Other small molecule dependent heterodimerization domains may also be used, including, but not limited to, gibberellin-induced dimerization system (GID1-GAI), trimethoprim-SLF induced ecDHFR and FKBP dimerization (Czlapinski et al., J Am Chem Soc., 2008, 130(40): 13186-13187) and ABA (abscisic acid) induced dimerization of PP2C and PYL domains (Cutler et al., Annu Rev Plant Biol. 2010, 61: 651-679). The dual regulation using inducible assembly (e.g., ligand dependent dimerization) and degradation (e.g., destabilizing domain induced CAR degradation) of the split CAR system may provide more flexibility to control the activity of the CAR modified T cells.

Switchable CAR

In some embodiments, the CAR of the disclosure may be a switchable CAR. Juillerat et al (Juilerat et al., Sci. Rep., 2016, 6: 18950; the contents of which are incorporated herein by reference in their entirety) recently reported controllable CARs that can be transiently switched on in response to a stimulus (e.g. a small molecule). In this CAR design, a system is directly integrated in the hinge domain that separate the scFv domain from the cell membrane domain in the CAR. Such system is possible to split or combine different key functions of a CAR such as activation and costimulation within different chains of a receptor complex, mimicking the complexity of the TCR native architecture. This integrated system can switch the scFv and antigen interaction between on/off states controlled by the absence/presence of the stimulus.

Reversible CAR

In other embodiments, the CAR of the disclosure may be a reversible CAR system. In this CAR architecture, a LID domain (ligand-induced degradation) is incorporated into the CAR system. The CAR can be temporarily down-regulated by adding a ligand of the LID domain. The combination of LID and DD mediated regulation provides tunable control of continuingly activated CAR T cells, thereby reducing CAR mediated tissue toxicity.

Activation-Conditional CAR

In some embodiments, the biocircuits described herein may include an activation-conditional chimeric antigen receptor, which is only expressed in an activated immune cell. The expression of the CAR may be coupled to activation conditional control region which refers to one or more nucleic acid sequences that induce the transcription and/or expression of a sequence e.g. a CAR under its control. Such activation conditional control regions may be promoters of genes that are upregulated during the activation of the effector immune cell e.g. IL2 promoter or NFAT binding sites. In some embodiments, activation of the immune cell may be achieved by a constitutively expressed CAR (International Publication NO. WO2016126608; the contents of which are incorporated herein by reference in their entirety).

Polynucleotides

Biocircuit components including effector modules, their SREs and payloads, may be nucleic acid-based. The term "nucleic acid," in its broadest sense, includes any compound and/or substance that comprise a polymer of nucleotides, e.g., linked nucleosides. These polymers are often referred to as polynucleotides. Exemplary nucleic acids or polynucleotides of the disclosure include, but are not limited to, ribonucleic acids (RNAs), deoxyribonucleic acids (DNAs), threose nucleic acids (TNAs), glycol nucleic acids (GNAs), peptide nucleic acids (PNAs), locked nucleic acids (LNAs, including LNA having a β-D-ribo configuration, α-LNA having an α-L-ribo configuration (a diastereomer of LNA), 2'-amino-LNA having a 2'-amino functionalization, and 2'-amino-α-LNA having a 2'-amino functionalization) or hybrids thereof.

In some embodiments, the nucleic acid molecule is a messenger RNA (mRNA). As used herein, the term "messenger RNA" (mRNA) refers to any polynucleotide which encodes a polypeptide of interest and which is capable of being translated to produce the encoded polypeptide of interest in vitro, in vivo, in situ or ex vivo. Polynucleotides described herein may be mRNA or any nucleic acid molecule and may or may not be chemically modified.

Traditionally, the basic components of an mRNA molecule include at least a coding region, a 5'UTR, a 3'UTR, a 5' cap and a poly-A tail. Building on this wild type modular structure, the present disclosure expands the scope of functionality of traditional mRNA molecules by providing payload constructs which maintain a modular organization, but which comprise one or more structural and/or chemical modifications or alterations which impart useful properties to the polynucleotide, for example tenability of function. As used herein, a "structural" feature or modification is one in which two or more linked nucleosides are inserted, deleted, duplicated, inverted or randomized in a polynucleotide without significant chemical modification to the nucleosides themselves. Because chemical bonds will necessarily be broken and reformed to effect a structural modification, structural modifications are of a chemical nature and hence are chemical modifications. However, structural modifications will result in a different sequence of nucleotides. For example, the polynucleotide "ATCG" may be chemically modified to "AT-5meC-G". The same polynucleotide may be structurally modified from "ATCG" to "ATCCCG". Here, the dinucleotide "CC" has been inserted, resulting in a structural modification to the polynucleotide.

In some embodiments, polynucleotides of the present disclosure may harbor 5'UTR sequences which play a role in translation initiation. 5'UTR sequences may include features such as Kozak sequences which are commonly known to be involved in the process by which the ribosome initiates translation of genes, Kozak sequences have the consensus XCCR(A/G) CCAUG, where R is a purine (adenine or guanine) three bases upstream of the start codon (AUG) and X is any nucleotide. In one embodiment, the Kozak sequence is ACCGCC. By engineering the features that are typically found in abundantly expressed genes of target cells or tissues, the stability and protein production of the polynucleotides of the disclosure can be enhanced.

Further provided are polynucleotides, which may contain an internal ribosome entry site (IRES) which play an important role in initiating protein synthesis in the absence of 5' cap structure in the polynucleotide. An IRES may act as the sole ribosome binding site or may serve as one of the multiple binding sites. Polynucleotides of the disclosure containing more than one functional ribosome binding site may encode several peptides or polypeptides that are translated independently by the ribosomes giving rise to bicistronic and/or multicistronic nucleic acid molecules.

In one embodiment, polynucleotides of the present disclosure may encode variant polypeptides which have a certain identity with a reference polypeptide sequence. As used herein, a "reference polypeptide sequence" refers to a starting polypeptide sequence. Reference sequences may be wild type sequences or any sequence to which reference is made in the design of another sequence.

The term "identity" as known in the art, refers to a relationship between two or more sequences, as determined by comparing the sequences. In the art, identity also means the degree of sequence relatedness between sequences, as determined by the number of matches between strings of two or more residues (amino acid or nucleic acid). Identity measures the percent of identical matches between two or more sequences with gap alignments (if any) addressed by a particular mathematical model or computer program (i.e., "algorithms"). Identity of related sequences can be readily calculated by known methods. Such methods include, but are not limited to, those described in Computational Molecular Biology, Lesk, A. M., ed., Oxford University Press, New York, 1988; Biocomputing: Informatics and Genome Projects, Smith, D. W., ed., Academic Press, New York, 1993; Computer Analysis of Sequence Data, Part 1, Griffin, A. M., and Griffin, H. G., eds., Humana Press, New Jersey, 1994; Sequence Analysis in Molecular Biology, von Heinje, G., Academic Press, 1987; Sequence Analysis Primer, Gribskov, M. and Devereux, J., eds., M. Stockton Press, New York, 1991; and Carillo et al., SIAM J. Applied Math. 48, 1073 (1988).

In some embodiments, the variant sequence may have the same or a similar activity as the reference sequence. Alternatively, the variant may have an altered activity (e.g., increased or decreased) relative to a reference sequence. Generally, variants of a particular polynucleotide or polypeptide of the disclosure will have at least about 40%, 45%, 50%, 55%, 60%, 65%, 70%, 75%, 80%, 85%, 90%, 91%, 92%, 93%, 94%, 95%, %%, 97%, 98%, 99% but less than 100% sequence identity to that particular reference poly-nucleotide or polypeptide as determined by sequence align-ment programs and parameters described herein and known to those skilled in the art. Such tools for alignment include those of the BLAST suite (Stephen F. Altschul, Thomas L. Madden, Alejandro A. Schäffer, Jinghui Zhang, Zheng Zhang, Webb Miller, and David J. Lipman (1997), "Gapped BLAST and PSI-BLAST: a new generation of protein data-base search programs", Nucleic Acids Res. 25:3389-3402.)

Chemical Modifications to Polynucleotides

According to the present disclosure, the terms "modifi-cation" or, as appropriate, "modified" polynucleotides refer to modification with respect to A, G, U (T in DNA) or C nucleotides.

Modifications of the polynucleotides of the disclosure may be on the nucleoside base and/or sugar portion of the nucleosides which comprise the polynucleotide. In some embodiments, multiple modifications are included in the modified nucleic acid or in one or more individual nucleo-side or nucleotide. For example, modifications to a nucleo-side may include one or more modifications to the nucle-obase and the sugar. Modifications to the polynucleotides of the present disclosure may include any of those taught in, for example, International Publication WO2013052523, the contents of which are incorporated herein by reference in its entirety.

As described herein "nucleoside" is defined as a com-pound containing a sugar molecule (e.g., a pentose or ribose) or a derivative thereof in combination with an organic base (e.g., a purine or pyrimidine) or a derivative thereof (also referred to herein as "nucleobase"). As described herein, "nucleotide" is defined as a nucleoside including a phos-phate group.

The modified nucleotides, which may be incorporated into a polynucleotide can be modified on the internucleoside linkage (e.g., phosphate backbone). Herein, in the context of the polynucleotide backbone, the phrases "phosphate" and "phosphodiester" are used interchangeably. Backbone phos-phate groups can be modified by replacing one or more of the oxygen atoms with a different substituent. Further, the modified nucleosides and nucleotides can include the whole-sale replacement of an unmodified phosphate moiety with another internucleoside linkage. Examples of modified phosphate groups include, but are not limited to, phospho-rothioate, phosphoroselenates boranophosphates, borano-phosphate esters, hydrogen phosphonates, phosphorami-dates, phosphorodiamidates, alkyl or aryl phosphonates, and phosphotriesters. Phosphorodithioates have both non-link-ing oxygens replaced by sulfur. The phosphate linker can also be modified by the replacement of a linking oxygen with nitrogen (bridged phosphoramidates), sulfur (bridged phosphorothioates), and carbon (bridged methylene-phos-phonates). Other modifications which may be used are taught in, for example, International Application WO2013052523, the contents of which are incorporated herein by reference in their entirety.

Different sugar modifications, nucleotide modifications, and/or internucleoside linkages (e.g., backbone structures) may exist at various positions in the polynucleotide. One of ordinary skill in the art will appreciate that the nucleotide analogs or other modification(s) may be located at any position(s) of a polynucleotide such that the function of the polynucleotide is not substantially decreased. A modification may also be a 5' or 3' terminal modification. The polynucle-otide may contain from about 1% to about 100% modified nucleotides (either in relation to overall nucleotide content, or in relation to one or more types of nucleotide, i.e. any one or more of A, G, U or C) or any intervening percentage (e.g., from 1% to 20%, from 1% to 25%, from 1% to 50%, from 1% to 60%, from 1% to 70%, from 1% to 80%, from 1% to 90%, from 1% to 95%, from 10% to 20%, from 10% to 25%, from 10% to 50%, from 10% to 60%, from 10% to 70%, from 10% to 80%, from 10% to 90%, from 10% to 95%, from 10% to 100%, from 20% to 25%, from 20% to 50%, from 20% to 60%, from 20% to 70%, from 20% to 80, from 20% to 90%, from 20% to 95%, from 20% to 100%, from 50% to 60%, from 50% to 70%, from 50% to 80, from 50% to 90% from 50% to 95%, from 50% to 100%, from 70% to 80%, from 70% to 90%, from 70% to 95%, from 70% to 100%, from 80% to 90%, from 80 to 95%, from 80% to 100%, from 90% to 95%, from 90% to 100% and from 95% to 100%).

In some embodiments, the polynucleotide includes a modified pyrimidine or purine. In some embodiments, the pyrimidine or purine in the polynucleotide molecule may be replaced with from about 1% to about 100% of a modified uracil or modified uridine (e.g., from 1% to 20%, from 1% to 25%, from 1% to 50%, from 1% to 60%, from 1% to 70%, from 1% to 80%, from 1% to 90%, from 1% to 95%, from 10% to 20%, from 10% to 25%, from 10% to 50%, from 10% to 60%, from 10% to 70%, from 10% to 80%, from 10% to 90%, from 10% to 95%, from 10% to 100%, from 20% to 25%, from 20% to 50%, from 20% to 60%, from 20% to 70%, from 20% to 80%, from 20% to 90%, from 20% to 95%, from 20% to 100%, from 50% to 60%, from 50% to 70%, from 50% to 80%, from 50% to 90%, from 50% to 95%, from 50% to 100%, from 70% to 80%, from 70% to 90%, from 70% to 95%, from 70% to 100%, from 80% to 90%, from 80% to 95%, from 80% to 100%, from 90% to 95%, from 90% to 100%, and from 95% to 100% of a modified pyrimidine or purine.

In some embodiments, the polynucleotides may comprise two or more effector module component sequences which are in a pattern such as ABABAB or AABBAABBAABB or ABCABCABC or variants thereof repeated once, twice, or more than three times. In these patterns, each letter, A, B, or C represent a different effector module component.

In yet another embodiment, the polynucleotides may comprise two or more effector module component sequences with each component having one or more sequences. As a non-limiting example, the sequences may be in a pattern such as ABABAB or AABBAABBAABB or ABCAB-CABC or variants thereof repeated once, twice, or more than three times in each of the regions. As another non-limiting example, the sequences may be in a pattern such as ABA-BAB or AABBAABBAABB or ABCABCABC or variants thereof repeated once, twice, or more than three times across the entire polynucleotide. In these patterns, each letter, A, B, or C represent a different sequence or component.

Codon Selection

In some embodiments, one or more codons of the poly-nucleotides of the present disclosure may be replaced with other codons encoding the native amino acid sequence to tune the expression of the SREs, through a process referred to as codon selection. Since mRNA codon, and tRNA anticodon pools tend to vary among organisms, cell types, sub cellular locations and over time, the codon selection described herein is a spatiotemporal (ST) codon selection.

In some embodiments of the disclosure, certain poly-nucleotide features may be codon optimized. Codon opti-mization refers to a process of modifying a nucleic acid sequence for enhanced expression in the host cell by replacing at least 1, 2, 3, 4, 5, 10, 15, 20, 25, 50 or more codons of the native sequence with codons that are most frequently used in the genes of that host cell while maintaining the native amino acid sequence. Codon usage may be measured using the Codon Adaptation Index (CAI) which measures the deviation of a coding polynucleotide sequence from a reference gene set. Codon usage tables are available at the Codon Usage Database (http://www.kazusa.or.jp/codon/) and the CAI can be calculated by EMBOSS CAI program (http://emboss.sourceforge.net/). Codon optimization methods are known in the art and may be useful in efforts to achieve one or more of several goals. These goals include to match codon frequencies in target and host organisms to ensure proper folding, bias nucleotide content to alter stability or reduce secondary structures, minimize tandem repeat codons or base runs that may impair gene construction or expression, customize transcriptional and translational control regions, insert or remove protein signaling sequences, remove/add post translation modification sites in encoded protein (e.g. glycosylation sites), add, remove or shuffle protein domains, insert or delete restriction sites, modify ribosome binding sites and degradation sites, to adjust translational rates to allow the various domains of the protein to fold properly, or to reduce or eliminate problem secondary structures within the polynucleotide. In one embodiment, a polynucleotide sequence or portion thereof is codon optimized using optimization algorithms. Codon options for each amino acid are well-known in the art as are various species table for optimizing for expression in that particular species.

In some embodiments of the disclosure, certain polynucleotide features may be codon optimized. For example, a preferred region for codon optimization may be upstream (5') or downstream (3') to a region which encodes a polypeptide. These regions may be incorporated into the polynucleotide before and/or after codon optimization of the payload encoding region or open reading frame (ORF).

After optimization (if desired), the polynucleotides components are reconstituted and transformed into a vector such as, but not limited to, plasmids, viruses, cosmids, and artificial chromosomes.

The stop codon of the polynucleotides of the present disclosure may be modified to include sequences and motifs to alter the expression levels of the SREs, payloads and effector modules of the present disclosure. Such sequences may be incorporated to induce stop codon readthrough, wherein the stop codon may specify amino acids e.g. selenocysteine or pyrrolysine. In other instances, stop codons may be skipped altogether to resume translation through an alternate open reading frame. Stop codon read through may be utilized to tune the expression of components of the effector modules at a specific ratio (e.g. as dictated by the stop codon context). Examples of preferred stop codon motifs include UGAN, UAAN, and UAGN, where N is either C or U.

Suppression of termination occurs during translation of many viral mRNAs as a means of generating a second protein with extended carboxy terminus. In retroviruses, gag and pol genes are encoded by a single mRNA and separated by an amber termination codon UAG. Translational suppression of the amber codon allows synthesis of the gag pol precursor. Translation suppression is mediated by suppressor tRNAs that can recognize termination codons and insert a specific amino acid. In some embodiments, effector modules described herein may incorporate amber termination codons. Such codons may be used in lieu of or in addition to IRES and p2A sequences in bicistronic constructs. Stop codon read through may be combined with P2A to obtain low level expression of a downstream gene. In some embodiments, the amber stop codons may be combined with tRNA expression or amino-acyl tRNA synthetase for further control.

Conjugates

It is contemplated by the present disclosure that the compositions of the present invention may be complexed, conjugated or combined with one or more homologous or heterologous molecules. As used herein, the term "homologous molecule" refers to a molecule which is similar in at least one of structure or function relative to a starting molecule while a "heterologous molecule" is one that differs in at least one of structure or function relative to a starting molecule. Structural homologs are therefore molecules which may be substantially structurally similar. In some embodiments, such homologs may be identical. Functional homologs are molecules which may be substantially functionally similar. In some embodiments, such homologs may be identical.

Pharmaceutical compositions, biocircuits, biocircuit components, effector modules including their SREs or payloads of the present disclosure may comprise conjugates. Such conjugates of the disclosure may include naturally occurring substances or ligands, such as proteins (e.g., human serum albumin (HSA), low-density lipoprotein (LDL), high-density lipoprotein (HDL), or globulin); carbohydrates (e.g., a dextran, pullulan, chitin, chitosan, inulin, cyclodextrin or hyaluronic acid); or lipids. Conjugates may also be recombinant or synthetic molecules, such as synthetic polymers, e.g., synthetic polyamino acids, an oligonucleotide (e.g. an aptamer). Examples of polyamino acids may include polylysine (PLL), poly L-aspartic acid, poly L-glutamic acid, styrene-maleic acid anhydride copolymer, poly(L-lactide-co-glycolied) copolymer, divinyl ether-maleic anhydride copolymer, N-(2-hydroxypropyl) methacrylamide copolymer (HMPA), polyethylene glycol (PEG), polyvinyl alcohol (PVA), polyurethane, poly (2-ethylacryllic acid), N-isopropylacrylamide polymers, or polyphosphazine. Example of polyamines include: polyethylenimine, polylysine (PLL), spermine, spermidine, polyamine, pseudopeptide-polyamine, peptidomimetic polyamine, dendrimer polyamine, arginine, amidine, protamine, cationic lipid, cationic porphyrin, quaternary salt of a polyamine, or an alpha helical peptide.

In some embodiments, conjugates may also include targeting groups. As used herein, the term "targeting group" refers to a functional group or moiety attached to an agent that facilitates localization of the agent to a desired region, tissue, cell and/or protein. Such targeting groups may include but are not limited to cell or tissue targeting agents or groups (e.g. lectins, glycoproteins, lipids, proteins, an antibody that binds to a specified cell type such as a kidney cell or other cell type). In some embodiments, targeting groups may comprise thyrotropins, melanotropins, lectins, glycoproteins, surfactant protein A, mucin carbohydrates, multivalent lactose, multivalent galactose, N-acetyl-galactosamine, N-acetyl-gulucosamine, multivalent mannose, multivalent fucose, glycosylated polyaminoacids, multivalent galactose, transferrin, bisphosphonate, polyglutamate, polyaspartate, lipids, cholesterol, steroids, bile acids, folates, vitamin B12, biotin, an RGD peptide, an RGD peptide mimetic or an aptamer.

In some embodiments, targeting groups may be proteins, e.g., glycoproteins, or peptides, e.g., molecules having a specific affinity for a co-ligand, or antibodies e.g., an antibody, that binds to a specified cell type such as a cancer cell, endothelial cell, or bone cell. Targeting groups may also comprise hormones and/or hormone receptors.

In some embodiments, targeting groups may be any ligand capable of targeting specific receptors. Examples include, without limitation, folate, GalNAc, galactose, mannose, mannose-6-phosphate, apatamers, integrin receptor ligands, chemokine receptor ligands, transferrin, biotin, serotonin receptor ligands, PSMA, endothelin, GCPII, somatostatin, LDL, and HDL ligands. In some embodiments, targeting groups are aptamers. Such aptamers may be unmodified or comprise any combination of modifications disclosed herein.

In still other embodiments, pharmaceutical compositions, biocircuits, biocircuit components, effector modules including their SREs or payloads of the present disclosure may be covalently conjugated to cell penetrating polypeptides. In some embodiments, cell-penetrating peptides may also include signal sequences. In some embodiments, conjugates of the disclosure may be designed to have increased stability, increased cell transfection and/or altered biodistribution (e.g., targeted to specific tissues or cell types.)

In some embodiments, conjugating moieties may be added to pharmaceutical compositions, biocircuits, biocircuit components, effector modules including their SREs or payloads of the present disclosure such that they allow the attachment of detectable labels to targets for clearance. Such detectable labels include, but are not limited to biotin labels, ubiquitins, fluorescent molecules, human influenza hemagglutinin (HA), c-myc, histidine (His), flag, glutathione S-transferase (GST), V5 (a paramyxovirus of simian virus 5 epitope), biotin, avidin, streptavidin, horse radish peroxidase (HRP) and digoxigenin.

In some embodiments, pharmaceutical compositions, biocircuits, biocircuit components, effector modules including their SREs or payloads of the present disclosure may be combined with one another or other molecules in the treatment of diseases and/or conditions.

Additional Effector Module Features

The effector module of the present disclosure may further comprise a signal sequence which regulates the distribution of the payload of interest, a cleavage and/or processing feature which facilitate cleavage of the payload from the effector module construct, a targeting and/or penetrating signal which can regulate the cellular localization of the effector module, a tag, and/or one or more linker sequences which link different components of the effector module.

Signal Sequences

In addition to the SRE and payload region, effector modules of the disclosure may further comprise one or more additional features such as one or more signal sequences.

Signal sequences (sometimes referred to as signal peptides, targeting signals, target peptides, localization sequences, transit peptides, leader sequences or leader peptides) direct proteins (e.g., the effector module of the present disclosure) to their designated cellular and/or extracellular locations. Protein signal sequences play a central role in the targeting and translocation of nearly all secreted proteins and many integral membrane proteins.

A signal sequence is a short (5-30 amino acids long) peptide present at the N-terminus of the majority of newly synthesized proteins that are destined towards a particular location. Signal sequences can be recognized by signal recognition particles (SRPs) and cleaved using type I and type II signal peptide peptidases. Signal sequences derived from human proteins can be incorporated as a regulatory module of the effector module to direct the effector module to a particular cellular and/or extracellular location. These signal sequences are experimentally verified and can be cleaved (Zhang Z. and Henzel W. J.; "Signal peptide prediction based on analysis of experimentally verified cleavage sites."; *Protein Sci.* 2004, 13:2819-2824).

In some embodiments, a signal sequence may be, although not necessarily, located at the N-terminus or C-terminus of the effector module, and may be, although not necessarily, cleaved off the desired effector module to yield a "mature" payload.

In some embodiments, the signal sequence used herein may exclude the methionine at the position 1 of amino acid sequence of the signal sequence. This may be referred to as an M1del mutation.

In addition to signal sequences naturally occurring such as from a secreted protein, a signal sequence may be a variant modified from a known signal sequence of a protein. For example, U.S. Pat. Nos. 8,258,102 and 9,133,265 to Sleep disclose a modified albumin signal sequence having a secretion signal and an additional X1-X2-X3-X4-X5-motif which can increase protein secretion; U.S. Pat. No. 9,279,007 to Do discloses signal sequences of modified fragments of human immunoglobulin heavy chain binding protein (Bip) that can enhance protein expression and secretion; U.S. Pat. No. 8,148,494 to Leonhartsberger et al., discloses a signal peptide with a cleavage site that can be fused with a recombinant protein; the contents of each of which are incorporated by reference in their entirety.

In some instances, the secreted signal sequences may be cytokine signal sequences such as, but not limited to, IL2 signal sequence or a p40 signal sequence.

In some instances, signal sequences directing the payload of interest to the surface membrane of the target cell may be used. Expression of the payload on the surface of the target cell may be useful to limit the diffusion of the payload to non-target in vivo environments, thereby potentially improving the safety profile of the payloads. Additionally, the membrane presentation of the payload may allow for physiologically and qualitative signaling as well as stabilization and recycling of the payload for a longer half-life. Membrane sequences may be the endogenous signal sequence of the N terminal component of the payload of interest. Optionally, it may be desirable to exchange this sequence for a different signal sequence. Signal sequences may be selected based on their compatibility with the secretory pathway of the cell type of interest so that the payload is presented on the surface of the T cell. In some embodiments, the signal sequence may be IgE signal sequence, CD8a signal sequence (also referred to as CD8a leader), or IL15Ra signal sequence (also referred to as IL15Ra leader) or M1del CD8a signal sequence (also referred to as M1del CD8 leader sequence).

Other signal sequence variants may be used in the present effector module may include those discussed in U.S. patent application publication NOs.: 2007/0141666; PCT patent application publication NOs.: 1993/018181; the contents of each of which are incorporated herein by reference in their entirety.

Other examples of signal sequence variants may be a modified signal sequence discussed in U.S. Pat. Nos. 8,148, 494; 8,258,102; 9,133,265; 9,279,007; and U.S. patent application publication NO. 20070141666; and International patent application publication NO. WO1993018181; the contents of each of which are incorporated herein by reference in their entirety.

In other examples, a signal sequence may be a heterogeneous signal sequence from other organisms such as virus, yeast and bacteria, which can direct an effector module to a particular cellular site, such as a nucleus (e.g., EP 1209450). Other examples may include Aspartic Protease (NSP24) signal sequences from *Trichoderma* that can increase secretion of fused protein such as enzymes (e.g., U.S. Pat. No. 8,093,016 to Cervin and Kim), bacterial lipoprotein signal sequences (e.g., PCT application publication NO. WO199109952 to Lau and Rioux), *E. coli* enterotoxin II signal peptides (e.g., U.S. Pat. No. 6,605,697 to Kwon et al.), *E. coli* secretion signal sequence (e.g., U.S. patent publication NO. US2016090404 to Malley et al.), a lipase signal sequence from a methylotrophic yeast (e.g., U.S. Pat. No. 8,975,041), and signal peptides for DNases derived from *Coryneform bacteria* (e.g., U.S. Pat. No. 4,965,197); the contents of each of which are incorporated herein by reference in their entirety.

Signal sequences may also include nuclear localization signals (NLSs), nuclear export signals (NESs), polarized cell tubulo-vesicular structure localization signals (See, e.g., U.S. Pat. No. 8,993,742; Cour et al., *Nucleic Acids Res.* 2003, 31(1): 393-3%; the contents of each of which are incorporated herein by reference in their entirety), extracellular localization signals, signals to subcellular locations (e.g. lysosome, endoplasmic reticulum, golgi, mitochondria, plasma membrane and peroxisomes, etc.) (See, e.g., U.S. Pat. No. 7,396,811; and Negi et al., *Database,* 2015, 1-7; the contents of each of which are incorporated herein by reference in their entirety).

Cleavage Sites

In some embodiments, the effector module comprises a cleavage and/or processing feature.

The effector module of the present disclosure may include at least one protein cleavage signal/site. The protein cleavage signal/site may be located at the N-terminus, the C-terminus, at any space between the N- and the C-termini such as, but not limited to, half-way between the N- and C-termini, between the N-terminus and the half-way point, between the half-way point and the C-terminus, and combinations thereof.

The effector module may include one or more cleavage signal(s)/site(s) of any proteinases. The proteinases may be a serine proteinase, a cysteine proteinase, an endopeptidase, a dipeptidase, a metalloproteinase, a glutamic proteinase, a threonine proteinase and an aspartic proteinase. In some aspects, the cleavage site may be a signal sequence of furin, actinidain, calpain-1, carboxypeptidase A, carboxypeptidase P, carboxypeptidase Y, caspase-1, caspase-2, caspase-3, caspase-4, caspase-5, caspase-6, caspase-7, caspase-8, caspase-9, caspase-10, cathepsin B, cathepsin C, cathepsin G, cathepsin H, cathepsin K, cathepsin L, cathepsin S, cathepsin V, clostripain, chymase, chymotrypsin, elastase, endoproteinase, enterokinase, factor Xa, formic acid, granzyme B, Matrix metallopeptidase-2, Matrix metallopeptidase-3, pepsin, proteinase K, SUMO protease, subtilisin, TEV protease, thermolysin, thrombin, trypsin and TAGZyme.

Tags

In some embodiments, the effector module comprises a protein tag.

The protein tag may be used for detecting and monitoring the process of the effector module. The effector module may include one or more tags such as an epitope tag (e.g., a FLAG or hemagglutinin (HA) tag). A large number of protein tags may be used for the present effector modules. They include, but are not limited to, self-labeling polypeptide tags (e.g., haloalkane dehalogenase (halotag2 or halotag7), ACP tag, clip tag, MCP tag, snap tag), epitope tags (e.g., FLAG, HA, His, and Myc), fluorescent tags (e.g., green fluorescent protein (GFP), red fluorescent protein (RFP), yellow fluorescent protein (YFP), and its variants), bioluminescent tags (e.g. luciferase and its variants), affinity tags (e.g., maltose-binding protein (MBP) tag, glutathione-S-transferase (GST) tag), immunogenic affinity tags (e.g., protein A/G, IRS, AU1, AU5, glu-glu, KT3, S-tag, HSV, VSV-G, Xpress and V5), and other tags (e.g., biotin (small molecule), StrepTag (StrepII), SBP, biotin carboxyl carrier protein (BCCP), eXact, CBP, CYD, HPC, CBD intein-chitin binding domain, Trx, NorpA, and NusA.

In other embodiments, a tag may also be selected from those disclosed in U.S. Pat. Nos. 8,999,897; 8,357,511; 7,094, 568; 5,011,912; 4,851,341; and 4,703,004; U.S. patent application publication NOs. US2013115635 and US2013012687; and International application publication NO. WO2013091661; the contents of each of which are incorporated herein by reference in their entirety.

In some aspects, a multiplicity of protein tags, either the same or different tags, may be used; each of the tags may be located at the same N or C terminus, whereas in other cases these tags may be located at each terminus.

Linkers

In some embodiments, the effector module comprises a linker.

In some embodiments, the effector module of the disclosure may further comprise a linker sequence. The linker region serves primarily as a spacer between two or more polypeptides within the effector module. The "linker" or "spacer", as used herein, refers to a molecule or group of molecules that connects two molecules, or two parts of a molecule such as two domains of a recombinant protein.

In some embodiments, "Linker" (L) or "linker domain" or "linker region" or "linker module" or "peptide linker" as used herein refers to an oligo- or polypeptide region of from about 1 to 100 amino acids in length, which links together any of the domains/regions of the effector module (also called peptide linker). The peptide linker may be 1-40 amino acids in length, or 2-30 amino acids in length, or 20-80 amino acids in length, or 50-100 amino acids in length. Linker length may also be optimized depending on the type of payload utilized and based on the crystal structure of the payload. In some instances, a shorter linker length may be preferably selected. In some aspects, the peptide linker is made up of amino acids linked together by peptide bonds, preferably from 1 to 20 amino acids linked by peptide bonds, wherein the amino acids are selected from the 20 naturally occurring amino acids: Glycine (G), Alanine (A), Valine (V), Leucine (L), Isoleucine (I), Serine (S), Cysteine (C), Threonine (T), Methionine (M), Proline (P), Phenylalanine (F), Tyrosine (Y), Tryptophan (W), Histidine (H), Lysine (K), Arginine (R), Aspartate (D), Glutamic acid (E), Asparagine (N), and Glutamine (Q). One or more of these amino acids may be glycosylated, as is understood by those in the art.

A linker sequence may be a natural linker derived from a multi-domain protein. A natural linker is a short peptide sequence that separates two different domains or motifs within a protein.

In some aspects, linkers may be flexible or rigid. In other aspects, linkers may be cleavable or non-cleavable. As used herein, the terms "cleavable linker domain or region" or "cleavable peptide linker" are used interchangeably. In some embodiments, the linker sequence may be cleaved enzymatically and/or chemically.

The linkers of the present disclosure may also be non-peptide linkers. For example, alkyl linkers such as —NH—$(CH_2)$ a-C(O)—, wherein a=2-20 can be used. These alkyl linkers may further be substituted by any non-sterically hindering group such as lower alkyl (e.g., $C_1$-$C_6$) lower acyl, halogen (e.g., Cl, Br), CN, NH$_2$, phenyl, etc.

Targeting or Penetrating Peptides

In some embodiments, the effector module comprises a targeting and/or penetrating peptide.

Small targeting and/or penetrating peptides that selectively recognize cell surface markers (e.g. receptors, trans-membrane proteins, and extra-cellular matrix molecules) can be employed to target the effector module to the desired organs, tissues or cells. Short peptides (5-50 amino acid residues) synthesized in vitro and naturally occurring peptides, or analogs, variants, derivatives thereof, may be incorporated into the effector module for homing the effector module to the desired organs, tissues and cells, and/or subcellular locations inside the cells.

In some embodiments, a targeting sequence and/or penetrating peptide may be included in the effector module to drive the effector module to a target organ, or a tissue, or a cell (e.g., a cancer cell). In other embodiments, a targeting and/or penetrating peptide may direct the effector module to a specific subcellular location inside a cell. As non-limiting examples, such targeting sequences and/or penetrating peptides may include those for targeting the effector module to desired region of the central nervous system (e.g., U.S. Pat. No. 9,259,432; U.S. application publication NO.: 2015/259392); or adipose tissue (e.g., U.S. Pat. Nos. 8,067,377 and 8,710,017); or prostate (e.g., U.S. patent publication NO.: 2016/0046668); the contents of each of which are incorporated herein by reference in their entirety.

In other embodiments, a targeting and/or penetrating peptide may direct the effector module to a specific subcellular location inside a cell. As a non-limiting example, a mitochondrion targeting peptide and/or a mitochondria membrane penetrating peptide may be included in the effector module to drive the effector module to the mitochondria of a cell. See e.g., U.S. Pat. Nos. 9,260,495; 9,173,952 and 9,132,198; and U.S. application publication NO.: 2015/361140; the contents of each of which are incorporated herein by reference in their entirety.

A targeting peptide has any number of amino acids from about 6 to about 30 inclusive. The peptide may have 6, 7, 8, 9, 10, 11, 12, 13, 14, 15, 16, 17, 18, 19, 20, 21, 22, 23, 24, 25, 26, 27, 28, 29 or 30 amino acids. Generally, a targeting peptide may have 25 or fewer amino acids, for example, 20 or fewer, for example 15 or fewer.

Naturally occurring small targeting and/or penetrating peptides that recognize specific tissues or cells bind cell surface molecules (e.g. receptors, trans-membrane proteins) with high affinity, which make them attractive trafficking moieties. Such peptides may include peptide toxins from microbes, insects (e.g. scorpion, honey bee, spider), animals (e.g. snake) and plants, and analogs, variants and derivatives thereof; and secreted peptide hormones, ligands and signal peptides.

In some aspects, analogs, variants and derivatives from natural toxins that abolish their cytotoxic activities may be used as targeting peptides. Exotoxin is a toxin secreted by bacteria. Many exotoxins have been shown to bind specific cell molecules. For example, enterotoxins, a group of protein toxins produced and secreted from bacterial organisms bind the mucosal (epithelial) cells of the intestinal wall. Enterotoxins may include, but are not limited to, *E. coli* heat stable enterotoxin (ST), Cholera toxin (CT), *E. coli* heat-labile enterotoxin (LT), *Bordetella pertussis*-derived pertussis toxin (PT), *Pseudomonas aeruginosa* exotoxin A (ETA), *Staphylococcus* enterotoxins, *Corynebacterium diphtheria*-derived diphtheria toxin, enterotoxin NSP4 from rotavirus.

Other exotoxins include neurotoxins which affect the nervous system, cardiotoxins which affect the heart, *pseudomonas* exotoxins, Botulinum neurotoxins, shiga toxin, shiga-like toxin 1 and 2, *Clostridium difficile* toxins, *Clostridium perfringens* epsilon toxin and anthrax toxin.

In addition to exotoxins, other toxins may include those isolated from plants such as maize RIP, gelonin, pokeweed antiviral protein, saporin, trichsanthin, ricin, abrin; scorpions such as Charybdotoxin; spider such as PcTx1; cone snail such as PcTx1; sea anemone such as gigantoxin 1; honey bees such as mellitins, a group of water-soluble, cationic, amphipathic 26 amino acid alpha-helical peptides isolated from the venoms of honey bee *Apis mellifera* (western or European or big honey bee), *Apis florea* (little or dwarf honey bee), *Apis dorsata* (giant honey bee) and *Apis cerana* (oriental honey bee); snake venom toxins, bombesin which is originally isolated from the skin of toad, which binds g-protein couple gastrin releasing peptide receptors (e.g. BBR-1/2/3) in the gastric tract and brain. See e.g. Suchanek, G., et al., *PNAS*(1978) 75:701-704; the contents of which are incorporated by reference in its entirety.

Peptides hormones and other signal peptides transfer important messages for cell to cell communications, which selectively bind cells that express their receptors with high affinity. In some aspects, peptide hormones may be included in the effector module. Such small peptide hormones and signal peptides may include, but are not limited to, adiponectin, adipose-derived hormone, agouti signaling peptide, allatostatin, amylin, angiotensin, atrial natriuretic peptide, bomben-like peptide, big gastrin, betatrophin, bradykinin, calcitonin, corticotrophin releasing hormone, cosyntrophin, endothelin, enteroglucagon, FGF, FNDC5, follicle-stimulating hormone, gastrin, ghrelin, glucagon and glucagon-like peptide, gonadotrophin, granulocyte colony stimulating factor, growth hormone, growth hormone releasing hormone, hepcidin, human chorionic gonadotrophin, human placental lactogen, incretin, insulin and insulin analogs, insulin-like growth factor, leptin, little gastrin, liraglutide, luteinizing hormone, melanocortin, minigastrin, alpha-melanocyte-stimulating hormone, neuropeptide Y, nerve growth factor (NGF), neurotrophin-3/4, NPH insulin, orexin, obestatin, osteocalcin, pancreatic hormone, parathyroid hormone, peptide hormone, peptide YY, prolactin, preprohormone, relaxi, renin, salcatonin, somatostatin (SST), secretin, substance P, sincalide, teleost leptins, temporin, tesamorelin, thyroid stimulating hormone, urocortin, vasoactive intestinal peptide (VIP), VGF and Vitellogenin.

Targeting and penetrating peptides may also be engineered biomimetic peptides and/or chemically modified small peptides. Numerous peptides with specific motifs and sequences that target specific cells and tissues with high affinity and selectivity in normal or diseased conditions are identified. A synthetic targeting peptide may be up to 30 amino acids in length or may be longer. A targeting peptide generally has at least about 5 amino acids but may have fewer, for example, 4 amino acids, or 3 amino acids. Generally, a targeting peptide has any number of amino acids from about 6 to about 30 inclusive. Generally, a targeting peptide may have 25 or fewer amino acids, for example, 20 or fewer, for example 15 or fewer.

A chimeric peptide may also be synthesized with fused amino acids from naturally occurring proteins and artificial amino acid sequences.

Stimuli

Biocircuits of the present disclosure are triggered by one or more stimuli. Stimuli include a ligand, an externally added or endogenous metabolite, the presence or absence of a defined ligand, the presence or action of one or more effector modules, or a concentration gradient of ions or biomolecules or the like.

Ligands

In some embodiments, the stimulus is a ligand. Ligands may be nucleic acid-based, protein-based, lipid-based, organic, inorganic or any combination of the foregoing.

In some embodiments, the ligand may be, but is not limited to, a protein, peptide, nucleic acid, lipid, lipid derivative, sterol, steroid, metabolite, metabolite derivative, and small molecule.

In some embodiments, the stimulus is a small molecule. In some embodiments, the small molecules are cell permeable. In some embodiments, the small molecules are FDA-approved, safe and orally administered.

In some embodiments, the ligands bind to carbonic anhydrases. In some embodiments, the ligand binds to and inhibits carbonic anhydrase function and is herein referred to as carbonic anhydrase inhibitor.

In some embodiments, the ligand is a small molecule that binds to carbonic anhydrase 2. In one embodiment, the small molecule is CA2 inhibitor. Examples of CA2 inhibitors include, but are not limited to Celecoxib, Valdecoxib, Rofecoxib, Acetazolamide, Methazolamide, Dorzolamide, Brinzolamide, Diclofenamide, Ethoxzolamide, Zonisamide, Dansylamide, and Dichlorphenamide.

In some embodiments, the ligands may comprise portions of small molecules known to mediate binding to CA2. Ligands may also be modified to reduce off-target binding to carbonic anhydrases other than CA2 and increase specific binding to CA2.

Ligands may also be selected from the analysis of the dependence of a known CA2 ligand's activity on its molecular/chemical structure, through Structure Activity Relationships (SAR) study. Any of the methods related to SAR, known in art may be utilized to identify stabilizing ligands of the disclosure. SAR may be utilized to improve properties of the ligand such as specificity, potency, pharmacokinetics, bioavailability, and safety. SAR analysis of known CA2 inhibitors may also be combined with high resolution X ray structures of CA2 complexed with ligands.

In one embodiment, the stimuli of the present disclosure may be FDA approved ligands capable of binding to the specific DDs or target regions within the DDs.

In some embodiments, ligands that do not affect the activity of the immune cell, and/or the chimeric antigen receptor, in the absence of the SREs may be preferably selected.

In some embodiments, two or more ligands may be utilized to stabilize the same stimulus response element.

Ligand and Conjugates

In some embodiments, the ligand may be complexed or bound to another molecule such as, but not limited to, another ligand, a protein, peptide, nucleic acid, lipid, lipid derivative, sterol, steroid, metabolite, metabolite derivative or small molecule. In some embodiments, the ligand stimulus is complexed to or bound to one or more other molecules. In some embodiments, the ligand stimulus is complexed or bound to one or more different kinds and/or numbers of other molecules. In some embodiments, the ligand stimulus is a multimer of the same kind of ligand. In some embodiments, the ligand stimulus multimer comprises 2, 3, 4, 5, 6, or more monomers.

Ligands such as small molecules that are well known to bind candidate proteins can be tested for their regulation in protein responses. The small molecules may be clinically approved to be safe and have appropriate pharmaceutical kinetics and distribution. In some embodiments, the stimulus is a ligand of a destabilizing domain (DD), for example, a small molecule that binds a destabilizing domain and stabilizes the POI fused to the destabilizing domain.

Promoters

In some embodiments, compositions of the disclosure comprise a promoter.

As used herein a promoter is defined as a DNA sequence recognized by transcription machinery of the cell, required to initiate specific transcription of the polynucleotide sequence of the present disclosure. Vectors can comprise native or non-native promoters operably linked to the polynucleotides of the disclosure. The promoters selected may be strong, weak, constitutive, inducible, tissue specific, development stage-specific, and/or organism specific. One example of a suitable promoter is the immediate early cytomegalovirus (CMV) promoter such as, but not limited to SEQ ID NO: 5635-5637. This promoter sequence is a strong constitutive promoter sequence capable of driving high levels of expression of polynucleotide sequence that is operatively linked to it. Another example of a promoter is Elongation Growth Factor-1 Alpha (EF-1 alpha) such as, but not limited to, SEQ ID NO: 5638-5642. Other constitutive promoters may also be used, including, but not limited to simian virus 40 (SV40), mouse mammary tumor virus (MMTV), human immunodeficiency virus (HIV), long terminal repeat (LTR), promoter, an avian leukemia virus promoter, an Epstein-Barr virus immediate early promoter, a Rous sarcoma virus promoter as well as human gene promoters including, but not limited to the phosphoglycerate kinase (PGK) promoter (non-limiting examples include SEQ ID NO: 5643-5650), actin promoter, the myosin promoter, the hemoglobin promoter, the Ubiquitin C (Ubc) promoter, the human U6 small nuclear protein promoter and the creatine kinase promoter. In some instances, inducible promoters such as but not limited to metallothionine promoter, glucocorticoid promoter, a progesterone promoter, and a tetracycline promoter may be used.

In some embodiments, the optimal promoter may be selected based on its ability to achieve minimal expression of the SREs and payloads of the disclosure in the absence of the ligand and detectable expression in the presence of the ligand.

Additional promoter elements e.g. enhancers may be used to regulate the frequency of transcriptional initiation. Such regions may be located 10-100 base pairs upstream or downstream of the start site. In some instances, two or more promoter elements may be used to cooperatively or independently activate transcription.

In some embodiments, the promoter of the disclosure may be a Tet-ON promoter. Combination of the transcription regulation Tet system with the DDs permits simultaneous control of gene expression and protein stability. Any of the dual-Tet ON-DD systems described by Pedone et al. (2018) doi: https://doi.org/10.1101/404699 may be useful in the present disclosure (the contents of which are herein incorporated by reference in their entirety.

Other Regulatory Features

In some embodiments, compositions of the disclosure may include optional proteasome adaptors. As used herein, the term "proteasome adaptor" refers to any nucleotide/amino acid sequence that targets the appended payload for degradation. In some aspects, the adaptors target the payload for degradation directly thereby circumventing the need for ubiquitination reactions. Proteasome adaptors may be used in conjunction with destabilizing domains to reduce the basal expression of the payload. Exemplary proteasome adaptors include the UbL domain of Rad23 or hHR23b, HPV E7 which binds to both the target protein Rb and the S4 subunit of the proteasome with high affinity, which allows direct proteasome targeting, bypassing the ubiquitination machinery; the protein gankyrin which binds to Rb and the proteasome subunit S6.

Exemplary Effector Module Constructs

Biocircuits of the present disclosure may comprise at least one effector module which may comprise at least one SRE derived from CA2 (referred to as "CA2 SREs") which may be operably linked to at least one payload of interest. These types of biocircuits and effector modules are referred to as "CA2 biocircuits" and "CA2 effector modules". Additionally, the CA2 effector module may comprise additional features including, but not limited to, signal sequences, linker, spacers, tags, flags, cleavage sites, and IRES. Any of the exemplary SREs (e.g., DDs), payloads of interest, signal sequences, linker, spacers, tags, flags, cleavage sites, and IRES taught herein or known in the art may be combined to create the CA2 effector modules of the present disclosure.

Payloads of Interest

In one embodiment, the CA2 effector module comprises a payload of interest. The payload of interest may be a wild-type polypeptide, a fragment of a wild-type polypeptide and/or comprise one or more mutations-relative to a wild-type polypeptide. Non-limiting examples of the payload of interest are shown in Table 7.

TABLE 7

| Payloads of Interest | | |
| --- | --- | --- |
| Payload | Amino Acid SEQ ID NO. | Nucleic Acid SEQ ID NO. |
| Interleukin-12 subunit beta (p40) | 4 | 10 |
| Interleukin-12 subunit beta (p40) (23-328 of WT) | 5763 | 5764-5773 |
| IL12B (p40) (23-328 of WT) (K217N) | 5774 | 5775 |
| Interleukin-12 subunit alpha (p35) | 1 | 7; 5776 |
| Interleukin-12 subunit alpha (p35) (57-253 of WT) | 5777 | 5778-5797 |
| IL12A (p35) (61-253 of WT) | 5798 | — |

In some embodiments, the payloads described herein may be co-expressed with a chimeric antigen receptor. In some embodiments, the payloads described herein may be co-expressed with an antigen-specific T cell receptor (TCR).

In one embodiment, the CA2 effector module produces regulated interleukin-12 (IL12). The CA2 effector module may include or be derived from any of the IL12-related sequences in Table 7. For example, the CA2 effector module may include a p40 and p35-derived payload. In one embodiment, at least one payload in the CA2 effector module is a p40 wild-type sequence (SEQ ID NO: 4, encoded by SEQ ID NO: 10). In one embodiment, at least one payload in the effector module is a region of the p40 wild-type sequence. As a non-limiting example, at least one payload in the effector module is amino acid 23-328 of the p40 wild-type sequence (SEQ ID NO: 5763, encoded by SEQ ID NO: 5764-5773). In one embodiment, at least one payload in the effector module is a p35 wild-type sequence (SEQ ID NO: 1, encoded by SEQ ID NO: 7; SEQ ID NO. 5776). In one embodiment, at least one payload in the effector module is a region of the p35 wild-type sequence. As a non-limiting example, at least one payload in the effector module is amino acid 57-253 of the p35 wild-type sequence (SEQ ID NO: 5777, encoded by SEQ ID NO: 5778-5797). As a non-limiting example, at least one payload in the effector module is amino acid 61-253 of the p35 wild-type sequence (SEQ ID NO: 5798). In one embodiment, at least one payload in the effector module is a region of p40 and/or p35 which does not include the transmembrane domain and/or cytoplasmic domain. The effector module may include a payload of a transmembrane domain and/or cytoplasmic domain from another parent protein as well as the p40 and/or p35 payload. In one embodiment, at least one payload in the effector module includes at least one mutation as compared to the wild-type sequence. In some embodiments, the IL12 may be a Flexi IL12, wherein both p35 and p40 subunits, are encoded by a single cDNA that produces a single chain polypeptide. The single chain polypeptide may be generated by placing p35 subunit at the N terminus or the C terminus of the single chain polypeptide. Similarly, the p40 subunit may be at the N terminus or C terminus of the single chain polypeptide.

In some embodiments, the payload may be IL12 that is membrane bound. The transmembrane domain may also include an optional hinge domain. In some aspects, the effector modules comprising membrane bound IL12 as the payload may be designed such that the DD remains intracellular whereas the IL12 molecule is extracellular and tethered to the cell by the transmembrane domain. In one embodiment, the membrane associated IL12 may be utilized to reduce systemic toxicity observed with soluble IL12. The membrane bound IL12 may be shed or cleaved from the cell surface by the action of proteases.

In some embodiments, an effector module of the present disclosure comprises a CA2 DD operably linked to a membrane-associated Interleukin 12 (IL12) payload. In some embodiments, the membrane-associate IL12 is a fusion protein comprising (a) Interleukin-12 subunit beta (p40); (b) Interleukin-12 subunit alpha (p35); (c) at least one linker, and (d) a transmembrane domain. In some embodiments, the fusion protein comprises, from the N-terminus, p40-linker-p35-transmembrane domain. In some embodiments, the fusion protein further comprises a second linker between p35 and the transmembrane domain. In some embodiments, an effector module comprises a third linker between the CA2 DD and the membrane-associated IL12. In some embodiments, an effector module comprises p40-(first) linker-p35-(second) linker-transmembrane domain-(third) linker-CA2 (aa 2-260 of WT, E106D). In some embodiments, an effector module comprises p40-(first) linker-p35-(second) linker-transmembrane domain-(third) linker-CA2 (aa 2-260 of WT, G63D). In some embodiments, an effector module comprises p40-(first) linker-p35-(second) linker-transmembrane domain-(third) linker-CA2 (aa 2-260 of WT, H122Y). In some embodiments, an effector module comprises p40-(first) linker-p35-(second) linker-transmembrane domain-(third) linker-CA2 (aa 2-260 of WT, I59N). In some embodiments, an effector module comprises p40-(first) linker-p35-(second) linker-transmembrane domain-(third) linker-CA2 (aa 2-260 of WT, L156H). In some embodiments, an effector module comprises p40-(first) linker-p35-(second) linker-transmembrane domain-(third) linker-CA2 (aa 2-260 of WT, L183S). In some embodiments, an effector module comprises p40-(first) linker-p35-(second) linker-transmembrane domain-(third) linker-CA2 (aa 2-260 of WT, L197P). In some embodiments, an effector module comprises p40-(first) linker-p35-(second) linker-transmembrane domain-(third) linker-CA2 (aa 2-260 of WT, S56F). In some embodiments, an effector module comprises p40-(first) linker-p35-(second) linker-transmembrane domain-(third) linker-CA2 (aa 2-260 of WT, S56N). In some embodiments, an effector module comprises p40-(first) linker-p35-(second) linker-transmembrane domain-(third) linker-CA2 (aa 2-260 of WT, W208S). In some embodiments, an effector module comprises p40-(first) linker-p35-(second) linker-transmembrane domain-(third) linker-CA2 (aa 2-260 of WT, Y193I). In some embodiments, an effector module comprises p40-(first) linker-p35-(second) linker-transmembrane domain-(third) linker-CA2 (aa 2-260 of WT, Y51T). As used herein, "aa 2-260 of WT" refers to amino acid positions 2-260 of wildtype CA2 (SEQ ID NO. 5810) and the position of the mutated amino acid in the CA2 DD is relative to SEQ ID NO. 5810. In some embodiments, an effector module comprises p40-(first) linker-p35-(second) linker-transmembrane domain-(third) linker-CA2 (aa 1-260 of WT, E106D). In some embodiments, an effector module comprises p40-(first) linker-p35-(second) linker-transmembrane domain-(third) linker-CA2 (aa 1-260 of WT, G63D). In some embodiments, an effector module comprises p40-(first) linker-p35-(second) linker-transmembrane domain-(third) linker-CA2 (an 1-260 of WT, H122Y). In some embodiments, an effector module comprises p40-(first) linker-p35-(second) linker-transmembrane domain-(third) linker-CA2 (an 1-260 of WT, I59N). In some embodiments, an effector module comprises p40-(first) linker-p35-(second) linker-transmembrane domain-(third) linker-CA2 (an 1-260 of WT, L156H). In some embodiments, an effector module comprises p40-(first) linker-p35-(second) linker-transmembrane domain-(third) linker-CA2 (an 1-260 of WT, L183S). In some embodiments, an effector module comprises p40-(first) linker-p35-(second) linker-transmembrane domain-(third) linker-CA2 (an 1-260 of WT, L197P). In some embodiments, an effector module comprises p40-(first) linker-p35-(second) linker-transmembrane domain-(third) linker-CA2 (aa 1-260 of WT, S56F). In some embodiments, an effector module comprises p40-(first) linker-p35-(second) linker-transmembrane domain-(third) linker-CA2 (aa 1-260 of WT, S56N). In some embodiments, an effector module comprises p40-(first) linker-p35-(second) linker-transmembrane domain-(third) linker-CA2 (aa 1-260 of WT, W208S). In some embodiments, an effector module comprises p40-(first) linker-p35-(second) linker-transmembrane domain-(third) linker-CA2 (an 1-260 of WT, Y193I). In some embodiments, an effector module comprises p40-(first) linker-p35-(second) linker-transmembrane domain-(third) linker-CA2 (aa 1-260 of WT, Y51T). As used herein, "aa 1-260 of WT" refers to amino acid positions 1-260 of wildtype CA2 (SEQ ID NO. 5810) and the position of the mutated amino acid in the CA2 DD is relative to SEQ ID NO. 5810.

In one aspect, the effector module of the present disclosure may be a DD-IL12 fusion polypeptide. This regulatable DD-IL12 fusion polypeptide may be directly used as an immunotherapeutic agent or be transduced into an immune effector cell (T cells and TIL cells) to generate modified T cells with greater in vivo expansion and survival capabilities for adoptive cell transfer. The need for harsh preconditioning regimens in current adoptive cell therapies may be minimized using regulated IL12. DD-IL12 may be utilized to modify tumor microenvironment and increase persistence in solid tumors that are currently refractory to tumor antigen targeted therapy. In some embodiments, CAR expressing T cells may be armored with DD regulated IL12 to relieve immunosuppression without systemic toxicity. In some embodiments, the payloads of the present invention may be used to enhance cell therapies with performance optimized for challenging tumor microenvironments.

In some embodiments, the IL12 expression may be tuned to generate a Th1 response in vivo. CD4+T cells differentiate into effector Th1 cells that are involved in Th1 response. Th1 cells produce IL2 and interferon gamma, which are involved in cell mediated responses. In some embodiments, compositions of the invention may be tuned to achieve low basal expression in the absence of the stimulus and IL12 levels sufficient to generate Th1 response. In some embodiments, compositions of the invention may be tuned to achieve low basal expression in the absence of stimulus and then expression is induced at least 1×, 2×, 3×, 4×, 5×, 6×, 7×, 8×, 9×, 10×, or more than 10× upon the addition of the drug.

The format of the IL12 constructs utilized as payload of the present invention may be optimized. In one embodiment, the payload of the invention may be a bicistronic IL12 containing p40 and p35 subunits separated by an internal ribosome entry site or a cleavage site such as P2A or Furin to allow independent expression of both subunits from a single vector. This results in a configuration of secreted IL12 that is more akin to the naturally occurring IL12 than the flexi IL12 construct. The payload of the invention may be the p40 subunit of the IL12. DD regulated p40 may be co-expressed with constitutive p35 construct to generate "regulatable IL12" expression. Alternatively, the DD regulated p40 may heterodimerize with the endogenous p35. p40 has been shown to stabilize p35 expression and stimulate the export of p35 (Jalah R, et al. (2013). Journal of Biol. Chem. 288, 6763-6776 (the contents of which are incorporated by reference in its entirety).

In some embodiments, modified forms of IL12 may be utilized as the payload. These modified forms of IL12 may be engineered to have shortened half-life in vivo compared to the non-modified form especially when used in combination with tunable systems described herein.

Human flexi IL12 has a reported half-life of 5-19 hours which, when administered as a therapeutic compound, can result in systemic cytotoxicity (Car et al. (1999) The Toxicology of Interleukin-12: A Review" Toxicologic Path. 27 A, 58-63; Robertson et al. (1999) "Immunological Effects of Interleukin 12 Administered by Bolus Intravenous Injection to Patients with Cancer" Clin. Cancer Res. 5:9-16; Atkins et al. (1997)"Phase I Evaluation of Intravenous Recombinant Human Interleukin 12 in Patients with Advance Malignancies" Clin. Cancer Res. 3:409-417). The ligand inducible control of IL12 can regulate production in a dose dependent fashion, the time from cessation of ligand dosing to cessation of protein synthesis and IL12 clearance may be insufficient to prevent toxic accumulation of IL12 in plasma.

In one embodiment, the modified form of IL12 utilized as the payload may be a Topo-sc IL12 which have the configuration as follows from N to C terminus (i) a first IL12 p40 domain (p40N), (ii) an optional first peptide linker, (iii) an IL12 p35 domain, (iv) an optional second peptide linker, and (v) a second IL12 p40 domain (p40C). In one embodiment, modified topo-sc-IL12 polypeptides exhibit increased susceptibility to proteolysis. Topo-sc IL12 is described in International Patent Publication No. WO2016048903; the contents of which are incorporated herein by reference in its entirety. Increased susceptibility of IL12 to proteolysis may also be achieved by engineering mutations within p40 and/or p35. Such mutations are described in International Patent Publications WO2017062953 and WO2016048903 (the contents of each of which are incorporated by reference in their entirety).

IL12 polypeptide may also be modified (e.g. genetically, synthetically, or recombinantly engineered) to increase susceptibility to proteinases to reduce the biologically active half-life of the IL12 complex, compared to a corresponding IL12 lacking proteinases susceptibility. Proteinase susceptible forms of IL12 are described in International Patent Publication No. WO2017062953; the contents of which are incorporated by reference in its entirety.

In some embodiments, the pharmacokinetic/pharmacodynamic measurements of IL12 in vivo may be assessed by measuring serum IL12 levels and/or downstream mediators of IL12 such as IL16, IL6 and IL10.

In some embodiments, the payload may be IL12 that is membrane bound. The transmembrane domain may also include an optional hinge domain. In some aspects, the effector modules comprising membrane bound IL12 as the payload may be designed such that the DD remains intracellular whereas the IL12 molecule is extracellular and tethered to the cell by the transmembrane domain. In one embodiment, the membrane associated IL12 may be utilized to reduced systemic toxicity observed with soluble IL12. The membrane bound IL12 may be shed or cleaved from the cell surface by the action of proteases.

In some embodiments, transmembrane and/or hinge domains that are resistant to the activity of proteases may be selected. Hinge domains that are resistant to proteases include but are not limited to hinge and/or transmembrane domains derived from B7.1 (also referred to as CD80), FCgr2b, IgG1. In some embodiments, the hinge and transmembrane domain may be derived from the C2 domain of B7.1 In one embodiment, the hinge and transmembrane domain may be derived from the CHD2-CH3 domain of IgG1. Membrane bound IL12 constructs may optionally include a cytoplasmic tail. As a non-limiting example the tail may be derived from B7.1 or CD8. In one aspect, the transmembrane domains may be derived from non-human species such as but not limited to *Mus musculus*. Transmembrane and hinge domains useful in the effector modules may be the complete domain or a region or portion of the domain.

In some embodiments, membrane associated IL12 effector modules described herein may include transmembrane domain derived from B7.1, and/or PDGFR. In some embodiments, the payload IL12 may be tethered to the membrane using a Glycosylphosphatidylinositol (GPI) anchor (Bozeman E N, et al. (2013) Vaccine. 7; 31(20): 2449-56; the contents of which are incorporated by reference in its entirety). In some embodiments, membrane associated IL12 effector modules may include immunoglobulin kappa chain signal peptide, an HA tag, Flexi IL12, B7.1 transmembrane domain and a B7.1 cytoplasmic tail. A linker may optionally be included between any two components of the membrane associated IL12 effector modules.

Any of the membrane associated IL12 constructs described in the following may be utilized in the effector modules described in the present disclosure including International Patent publication WO2017192924, Chakrabarti et al. 2004, Plasmids encoding membrane-bound IL-4 or IL-12 strongly co-stimulate DNA vaccination against carcinoembryonic antigen (CEA) Vaccine. 22.1199-205; Tao et al. 2005 Membrane-bound interleukin 12 induced stronger anti-tumor immunity than soluble interleukin 12 without inducing circulating interferon gamma. Cancer Res (65) (9 Supplement) 1410; and Pan et al. 2012. Cancer immunotherapy using a membrane-bound interleukin-12 with B7-1 transmembrane and cytoplasmic domains Mol Ther. 2012 May; 20(5):927-37; the contents of each of which are incorporated by reference in their entirety. Membrane associated IL12 effector modules may include miR binding sites designed to modulate the half-life of IL12 as described in the International Patent Publication WO2018213731 (the contents of which are incorporated by reference in their entirety). In one embodiment, tunability of IL12 effector modules may be achieved by incorporation of tunable domains described in the International Patent Publications WO2016048903 and WO2017062953 (the contents of which are incorporated by reference in their entirety).

In one embodiment, the intracellular domain of the membrane associated IL12 may be or may be derived from human CD80 intracellular domain such as but not limited to SEQ ID NO. 59%). In one embodiment, the intracellular domain of the membrane associated IL12 may be or may be derived from human PGFRB intracellular domain (WT) such as but not limited to SEQ ID NO. 5997). In one embodiment, the intracellular domain of the membrane associated IL12 may be or may be derived from human PGFRB intracellular domain (E570tr) such as but not limited to SEQ ID NO. 5998). In one embodiment, the intracellular domain of the membrane associated IL12 may be or may be derived from human PGFRB intracellular domain (E739tr) such as but not limited to SEQ ID NO. 5999). In one embodiment, the transmembrane domain of the membrane associated IL12 may be or may be derived from murine CD8 transmembrane domain such as but not limited to SEQ ID NO. 6000). In one embodiment, the transmembrane domain of the membrane associated IL12 may be or may be derived from murine PDGFR transmembrane domain such as but not limited to SEQ ID NO. 6001). In one embodiment, the transmembrane domain of the membrane associated IL12 may be or may be derived from murine CD80 transmembrane domain such as but not limited to SEQ ID NO. 6002). In on embodiment, the intracellular domain of the membrane associated IL12 may be or may be derived from murine CD80 intracellular domain such as but not limited to SEQ ID NO.6003).

In one embodiment, membrane associated IL12 effector modules may be include a cleavage site or the recognition sequence of a proteolytic enzyme. Inclusion of such cleavage sites may allow for the release of the IL12 from the cell surface. Cleavage sites that are the targeted by proteases known to be present in the tumor microenvironment e.g. MMP7, ADAM10 and ADAM17 may be selected. In some embodiments, such cleavage sites may be derived from FasL and or TNF. Any of the cleavage sites described in the following publications may be used in the effector modules described herein: Schneider, P. et al. Conversion of Membrane-bound Fas(CD95) Ligand to Its Soluble Form Is Associated with Downregulation of Its Proapoptotic Activity and Loss of Liver Toxicity. *J. Exp. Med.* 187, 1205-1213 (1998); and Schulte, M. et al. ADAM10 regulates FasL cell surface expression and modulates FasL-induced cytotoxicity and activation-induced cell death. Cell Death Differ. 14, 1040-1049 (2007) (the contents of each of which are incorporated by reference in their entirety).

The CA2 biocircuits and/or effector modules of the present disclosure may be monocistronic or multicistronic meaning one (monocistronic) or more than one (multicistronic) message (e.g., payload of interest) is produced. If two messages are produced, the CA2 biocircuit or effector module is considered bicistronic.

In one embodiment, at least one CA2 effector module of the present disclosure is monocistronic.

In one embodiment, at least one CA2 effector module of the present disclosure is multicistronic.

In one embodiment, at least one CA2 effector module of the present disclosure is bicistronic.

In one embodiment, the CA2 biocircuit of the present disclosure is monocistronic.

In one embodiment, the CA2 biocircuit of the present disclosure is multicistronic.

In one embodiment, the CA2 biocircuit of the present disclosure is bicistronic.

In some embodiments, the payload may be a fusion protein comprising any of the immunotherapeutic agents described and ubiquitin. Within the fusion protein, the ubiquitin may be positioned at the N terminus and the immunotherapeutic agent may be positioned at the C terminus. In one aspect, the immunotherapeutic agent may itself be a fusion protein and the ubiquitin may be located in between the proteins that are fused. The payloads may include a single ubiquitin protein or a chain of ubiquitin proteins. The ubiquitin protein may be linked to the immunotherapeutic agent through a single amino acid. The selection of the single amino acid may depend on the desired half-life of the fusion protein. In one embodiment, the immunotherapeutic agent may be IL12.

CA2 mbIL12 with CAR Effector Modules

In some embodiments, CA2 DDs described herein may be appended to membrane bound IL2 herein referred to as "mbIL12" using any of the components described in Table 8. Such effector modules may further be operably linked to any of the CARs described herein. Membrane associated IL12 constructs in tandem with CD19 CAR are provided in Table 9. Any of the DD described herein may be combined with the construct components in Table 8 to prepare regulated membrane bound IL12 constructs listed in Table 9. In Table 9, "*" represents the translation of the stop codon.

TABLE 8

| CA2 mbIL2 with CAR construct components | | |
|---|---|---|
| Component | AA SEQ ID NO. | NA SEQ ID NO. |
| CD8a Leader | 2682 | 2683 |
| CD8α leader (No Met) | 6004 | 6005 |

TABLE 8-continued

| CA2 mbIL2 with CAR construct components | | |
|---|---|---|
| Component | AA SEQ ID NO. | NA SEQ ID NO. |
| IL12b (p40) Leader | 3024 | 3030 |
| Interleukin-12 subunit beta (p40) (No met) | 6006 | 6007 |
| Linker (GS) | GS | GGATCA, GGATCC |
| Linker (G4S)3 | 3528 | 3532 |
| Linker (GS)15 | 5968 | 5969 |
| CD19 scFV | 204 | 210 |
| CD8a Hinge and Transmembrane Domain | 1021 | 1023 1022 |
| 4-1BB intracellular domain | 1259 | 1266 |
| CD3 zeta intracellular domain | 1145 | 1151 |
| P2A Cleavage Site | 3449 | 3450 |
| IL12B (p40) (23-328 of WT) | 5763 | 5769 |
| IL12A (p35) (57-253 of WT) | 5777 | 5786 |
| CA2 (aa 2-260 of WT, I59N, G102R) | 5757 | 5758 |
| CA2 (aa 2-260 of WT, L156H) | 5759 | 5760 |
| CA2 (aa 2-260 of WT, G63D, E69V, N231I) | 5867 | 5868 |
| CA2 (aa 2-260 of WT, R27L, T87I, H122Y, N252D) | 5821 | 5822 |
| B7-1 Hinge | 5982 | 5983 |
| B7-1 Transmembrane domain | 5984 | 5985 |
| B7-1 Tail | 5986 | 5987 |
| CD8 cytoplasmic tail | 5988 | 5989 |
| B7-1 C2 domain (includes B7-1 Hinge) | 5990 | 5991 |
| IgG1 Fc domain | 5992 | 5993 |
| FCgr2b Hinge | 5994 | 5995 |

TABLE 9

| | CA2 mbIL2 with CAR constructs | | |
|---|---|---|---|
| ID | AA Sequence | AA SEQ ID NO. | NA SEQ ID NO. |
| OT-002007 (CD8a Leader; CD19 scFV; CD8a Hinge and Transmembrane Domain; 4-1BB intracellular domain; CD3 zeta intracellular domain; Linker (GS) (BamH1 site); P2A Cleavage Site; IL12b (p40) Leader; IL12B (p40) (23-328 of WT); Linker ((G4S)3); IL12A (p35) (57-253 of WT); Linker ((GS)15); CD8a Hinge and Transmembrane Domain; 4-1BB intracellular domain; Linker (GS) (BamH1 site); CA2 (aa 2-260 of WT, I59N, G102R); Stop (TGA)) | MALPVTALLLPLALLLHAARPDIQMTQTTSSLSASLGDRVTISCRASQDIS KYLNWYQQKPDGTVKLLIYHTSRLHSGVPSRFSGSGSGTDYSLTISNLEQ EDIATYFCQQGNTLPYTFGGGTKLEITGGGGSGGGGSGGGGSEVKLQESG PGLVAPSQSLSVTCTVSGVSLPDYGVSWIRQPPRKGLEWLGVIWGSETTY YNSALKSRLTIIKDNSKSQVFLKMNSLQTDDTAIYYCAKHYYYGGSYAM DYWGQGTSVTVSSTTTPAPRPPTPAPTIASQPLSLRPEACRPAAGGAVHTR GLDFACDIYIWAPLAGTCGVLLLSLVITLYCKRGRKKLLYIFKQPFMRPV QTTQEEDGCSCRFPEEEEGGCELRVKFSRSADAPAYKQGQNQLYNELNL GRREEYDVLDKRRGRDPEMGGKPRRKNPQEGLYNELQKDKMAEAYSEI GMKGERRRGKGHDGLYQGLSTATKDTYDALHMQALPPRGSATNFSLLK QAGDVEENPGPMCHQQLVISWFSLVFLASPLVAIWELKKDVYVVELDW YPDAPGEMVVLTCDTPEEDGITWTLDQSSEVLGSGKTLTIQVKEFGDAGQ YTCHKGGEVLSHSLLLLHKKEDGIWSTDILKDQKEPKNKTFLRCEAKNYS GRFTCWWLTTISTDLTFSVKSSRGSSDPQGVTCGAATLSAERVRGDNKEY EYSVECQEDSACPAAEESLPIEVMVDAVHKLKYENYTSSFFIRDIIKPDPPK NLQLKPLKNSRQVEVSWEYPDTWSTPHSYFSLTFCVQVQGKSKREKKDR VFTDKTSATVICRKNASISVRAQDRYYSSSWSEWASVPCSGGGGSGGGGS GGGGSRNLPVATPDPGMFPCLHHSQNLLRAVSNMLQKARQTLEFYPCTS EEIDHEDITKDKTSTVEACLPLELTKNESCLNSRETSFITNGSCLASRKTSF MMALCLSSIYEDLKMYQVEFKTMNAKLLMDPKRQIFLDQNMLAVIDEL MQALNFNSETVPQKSSLEEPDFYKTKIKLCILLHAFRIRAVTIDRVMSYLN ASGSGSGSGSGSGSGSGSGSGSGSGSGSGSGSTTTPAPRPPTPAPTIASQPL SLRPEACRPAAGGAVHTRGLDFACDIYIWAPLAGTCGVLLLSLVITLYCG SSHHWGYGKHNGPEHWHKDFPIAKGERQSPVDIDTHTAKYDPSLKPLSV SYDQATSLRNLNNGHAFNVEFDDSQDKAVLKGGPLDGTYRLIQFHFHWG SLDRQGSEHTVDKKKYAAELHLVHWNTKYGDFGKAVQQPDGLAVLGIF LKVGSAKPGLQKVVDVLDSIKTKGKSADFTNFDPRGLLPESLDYWTYPG | 5970 | 5971 |

TABLE 9-continued

CA2 mbIL2 with CAR constructs

| ID | AA Sequence | AA SEQ ID NO. | NA SEQ ID NO. |
|---|---|---|---|
| | SLTTPPLLECVTWIVLKEPISVSSEQVLKFRKLNFNGEGEPEELMVDNWRP AQPLKNRQIKASFK* | | |
| OT-002008 (CD8a Leader; CD19 scFV; CD8a Hinge and Transmembrane Domain; 4-1BB intracellular domain; CD3 zeta intracellular domain; Linker (GS) (BamH1 site); P2A Cleavage Site; IL12b (p40) Leader; IL12B (p40) (23-328 of WT); Linker ((G4S)3); IL12A (p35) (57-253 of WT); Linker ((GS)15); CD8a Hinge and Transmembrane Domain; 4-1BB intracellular domain; Linker (GS) (BamH1 site); CA2 (aa 2-260 of WT, L156H); Stop (TGA)) | MALPVTALLLPLALLLHAARPDIQMTQTTSSLSASLGDRVTISCRASQDIS KYLNWYQQKPDGTVKLLIYHTSRLHSGVPSRFSGSGSGTDYSLTISNLEQ EDIATYFCQQGNTLPYTFGGGTKLEITGGGGSGGGGSGGGGSEVKLQESG PGLVAPSQSLSVTCTVSGVSLPDYGVSWIRQPPRKGLEWLGVIWGSETTY YNSALKSRLTIIKDNSKSQVFLKMNSLQTDDTAIYYCAKHYYYGGSYAM DYWGQGTSVTVSSTTTPAPRPPTPAPTIASQPLSLRPEACRPAAGGAVHTR GLDFACDIYIWAPLAGTCGVLLLSLVITLYCKRGRKKLLYIFKQPFMRPV QTTQEEDGCSCRFPEEEEGGCELRVKFSRSADAPAYKQGQNQLYNELNL GRREEYDVLDKRRGRDPEMGGKPRRKNPQEGLYNELQKDKMAEAYSEI GMKGERRRGKGHDGLYQGLSTATKDTYDALHMQALPPRGSATNFSLLK QAGDVEENPGPMCHQQLVISWFSLVFLASPLVAIWELKKDVYVVELDW YPDAPGEMVVLTCDTPEEDGITWTLDQSSEVLGSGKTLTIQVKEFGDAGQ YTCHKGGEVLSHSLLLLHKKEDGIWSTDILKDQKEPKNKTFLRCEAKNYS GRFTCWWLTTISTDLTFSVKSSRGSSDPQGVTCGAATLSAERVRGDNKEY EYSVECQEDSACPAAEESLPIEVMVDAVHKLKYENYTSSFFIRDIIKPDPPK NLQLKPLKNSRQVEVSWEYPDTWSTPHSYFSLTFCVQVQGKSKREKKDR VFTDKTSATVICRKNASISVRAQDRYYSSSWSEWASVPCSGGGGSGGGGS GGGGSRNLPVATPDPGMFPCLHHSQNLLRAVSNMLQKARQTLEFYPCTS EEIDHEDITKDKTSTVEACLPLELTKNESCLNSRETSFITNGSCLASRKTSF MMALCLSSIYEDLKMYQVEFKTMNAKLLMDPKRQIFLDQNMLAVIDEL MQALNFNSETVPQKSSLEEPDFYKTKIKLCILLHAFRIRAVTIDRVMSYLN ASGSGSGSGSGSGSGSGSGSGSGSGSGSGSTTTPAPRPPTPAPTIASQPL SLRPEACRPAAGGAVHTRGLDFACDIYIWAPLAGTCGVLLLSLVITLYCG SSHHWGYGKHNGPEHWHKDFPIAKGERQSPVDIDTHTAKYDPSLKPLSV SYDQATSLRILNNGHAFNVEFDDSQDKAVLKGGPLDGTYRLIQFHFHWG SLDGQGSEHTVDKKKYAAELHLVHWNTKYGDFGKAVQQPDGLAVLGIF LKVGSAKPGHQKVVDVLDSIKTKGKSADPTNFDPRGLLPESLDYWTYPG SLTTPPLLECVTWIVLKEPISVSSEQVLKFRKLNFNGEGEPEELMVDNWRP AQPLKNRQIKASFK* | 5972 | 5973 |
| OT-002009 (CD8a Leader; CD19 scFV; CD8a Hinge and Transmembrane Domain; 4-1BB intracellular domain; CD3 zeta intracellular domain; Linker (GS) (BamH1 site); P2A Cleavage Site; IL12b (p40) Leader; IL12B (p40) (23-328 of WT); Linker ((G4S)3); IL12A (p35) (57-253 of WT); Linker ((GS)15); CD8a Hinge and Transmembrane Domain; 4-1BB intracellular domain; Linker (GS) (BamH1 site); CA2 (aa 2-260 of WT, L156H); Stop (TGA)) | MALPVTALLLPLALLLHAARPDIQMTQTTSSLSASLGDRVTISCRASQDIS KYLNWYQQKPDGTVKLLIYHTSRLHSGVPSRFSGSGSGTDYSLTISNLEQ EDIATYFCQQGNTLPYTFGGGTKLEITGGGGSGGGGSGGGGSEVKLQESG PGLVAPSQSLSVTCTVSGVSLPDYGVSWIRQPPRKGLEWLGVIWGSETTY YNSALKSRLTIIKDNSKSQVFLKMNSLQTDDTAIYYCAKHYYYGGSYAM DYWGQGTSVTVSSTTTPAPRPPTPAPTIASQPLSLRPEACRPAAGGAVHTR GLDFACDIYIWAPLAGTCGVLLLSLVITLYCKRGRKKLLYIFKQPFMRPV QTTQEEDGCSCRFPEEEEGGCELRVKFSRSADAPAYKQGQNQLYNELNL GRREEYDVLDKRRGRDPEMGGKPRRKNPQEGLYNELQKDKMAEAYSEI GMKGERRRGKGHDGLYQGLSTATKDTYDALHMQALPPRGSATNFSLLK QAGDVEENPGPMCHQQLVISWFSLVFLASPLVAIWELKKDVYVVELDW YPDAPGEMVVLTCDTPEEDGITWTLDQSSEVLGSGKTLTIQVKEFGDAGQ YTCHKGGEVLSHSLLLLHKKEDGIWSTDILKDQKEPKNKTFLRCEAKNYS GRFTCWWLTTISTDLTFSVKSSRGSSDPQGVTCGAATLSAERVRGDNKEY EYSVECQEDSACPAAEESLPIEVMVDAVHKLKYENYTSSFFIRDIIKPDPPK NLQLKPLKNSRQVEVSWEYPDTWSTPHSYFSLTFCVQVQGKSKREKKDR VFTDKTSATVICRKNASISVRAQDRYYSSSWSEWASVPCSGGGGSGGGGS GGGGSRNLPVATPDPGMFPCLHHSQNLLRAVSNMLQKARQTLEFYPCTS EEIDHEDITKDKTSTVEACLPLELTKNESCLNSRETSFITNGSCLASRKTSF MMALCLSSIYEDLKMYQVEFKTMNAKLLMDPKRQIFLDQNMLAVIDEL MQALNFNSETVPQKSSLEEPDFYKTKIKLCILLHAFRIRAVTIDRVMSYLN ASGSGSGSGSGSGSGSGSGSGSGSGSGSGSTTTPAPRPPTPAPTIASQPL SLRPEACRPAAGGAVHTRGLDFACDIYIWAPLAGTCGVLLLSLVITLYCG SSHHWGYGKHNGPEHWHKDFPIAKGERQSPVDIDTHTAKYDPSLKPLSV SYDQATSLRILNNGHAFNVEFDDSQDKAVLKGGPLDGTYRLIQFHFHWG SLDGQGSEHTVDKKKYAAELHLVHWNTKYGDFGKAVQQPDGLAVLGIF LKVGSAKPGHQKVVDVLDSIKTKGKSADPTNFDPRGLLPESLDYWTYPG SLTTPPLLECVTWIVLKEPISVSSEQVLKFRKLNFNGEGEPEELMVDNWRP AQPLKNRQIKASFK* | 5974 | 5975 |
| OT-002010 (CD8a Leader; CD19 scFV; CD8a Hinge and Transmembrane Domain; 4-1BB intracellular domain; CD3 zeta intracellular domain; Linker (GS) (BamH1 site); P2A Cleavage | MALPVTALLLPLALLLHAARPDIQMTQTTSSLSASLGDRVTISCRASQDIS KYLNWYQQKPDGTVKLLIYHTSRLHSGVPSRFSGSGSGTDYSLTISNLEQ EDIATYFCQQGNTLPYTFGGGTKLEITGGGGSGGGGSGGGGSEVKLQESG PGLVAPSQSLSVTCTVSGVSLPDYGVSWIRQPPRKGLEWLGVIWGSETTY YNSALKSRLTIIKDNSKSQVFLKMNSLQTDDTAIYYCAKHYYYGGSYAM DYWGQGTSVTVSSTTTPAPRPPTPAPTIASQPLSLRPEACRPAAGGAVHTR GLDFACDIYIWAPLAGTCGVLLLSLVITLYCKRGRKKLLYIFKQPFMRPV QTTQEEDGCSCRFPEEEEGGCELRVKFSRSADAPAYKQGQNQLYNELNL GRREEYDVLDKRRGRDPEMGGKPRRKNPQEGLYNELQKDKMAEAYSEI GMKGERRRGKGHDGLYQGLSTATKDTYDALHMQALPPRGSATNFSLLK | 5976 | 5977 |

TABLE 9-continued

| | CA2 mbIL2 with CAR constructs | | |
| --- | --- | --- | --- |
| ID | AA Sequence | AA SEQ ID NO. | NA SEQ ID NO. |
| Site; IL12b (p40) Leader; IL12B (p40) (23-328 of WT); Linker ((G4S)3); IL12A (p35) (57-253 of WT); Linker ((GS)15); CD8a Hinge and Transmembrane Domain; 4-1BB intracellular domain; Linker (GS) (BamH1 site); CA2 (aa 2-260 of WT, G63D, E69V, N231I); Stop (TGA)) | QAGDVEENPGPMCHQQLVISWFSLVFLASPLVAIWELKKDVYVVELDW YPDAPGEMVVLTCDTPEEDGITWTLDQSSEVLGSGKTLTIQVKEFGDAGQ YTCHKGGEVLSHSLLLLHKKEDGIWSTDILKDQKEPKNKTFLRCEAKNYS GRFTCWWLTTISTDLTFSVKSSRGSSDPQGVTCGAATLSAERVRGDNKEY EYSVECQEDSACPAAEESLPIEVMVDAVHKLKYENYTSSFFIRDIIKPDPPK NLQLKPLKNSRQVEVSWEYPDTWSTPHSYFSLTFCVQVQGKSKREKKDR VFTDKTSATVICRKNASISVRAQDRYYSSSWSEWASVPCSGGGGSGGGGS GGGGSRNLPVATPDPGMFPCLHHSQNLLRAVSNMLQKARQTLEFYPCTS EEIDHEDITKDKTSTVEACLPLELTKNESCLNSRETSFITNGSCLASRKTSF MMALCLSSIYEDLKMYQVEFKTMNALFNSETVPQKSSLEEPDFYKTKIKLCILLHAFRIRAVTIDRVMSYLN ASGSGSGSGSGSGSGSGSGSGSGSGSGSGSGSTTTPAPRPPTPAPTIASQPL SLRPEACRPAAGGAVHTRGLDFACDIYIWAPLAGTCGVLLLSLVITLYCG SSHHWGYGKHNGPEHWHKDFPIAKGERQSPVDIDTHTAKYDPSLKPLSV SYDQATSLRILNNDHAFNVVFDDSQDKAVLKGGPLDGTYRLIQFHFHWG SLDGQGSEHTVDKKKYAAELHLVHWNTKYGDFGKAVQQPDGLAVLGIF LKVGSAKPGLQKVVDVLDSIKTKGKSADFTNFDPRGLLPESLDYWTYPG SLTTPPLLECVTWIVLKEPISVSSEQVLKFRKLNFIGEGEPEELMVDNWRP AQPLKNRQIKASFK* | | |
| OT-002012 (CD8a Leader; CD19 scFV; CD8a Hinge and Transmembrane Domain; 4-1BB intracellular domain; CD3 zeta intracellular domain; Linker (GS) (BamH1 site); P2A Cleavage Site; IL12b (p40) Leader; IL12B (p40) (23-328 of WT); Linker ((G4S)3); IL12A (p35) (57-253 of WT); Linker ((GS)15); CD8a Hinge and Transmembrane Domain; 4-1BB intracellular domain; Linker (GS) (BamH1 site); CA2 (aa 2-260 of WT, R27L, T87I, H122Y, N252D); Stop (TGA)) | MALPVTALLLPLALLLHAARPDIQMTQTTSSLSASLGDRVTISCRASQDIS KYLNWYQQKPDGTVKLLIYHTSRLHSGVPSRFSGSGSGTDYSLTISNLEQ EDIATYFCQQGNTLPYTFGGGTKLEITGGGGSGGGGSGGGGSEVKLQESG PGLVAPSQSLSVTCTVSGVSLPDYGVSWIRQPPRKGLEWLGVIWGSETTY YNSALKSRLTIIKDNSKSQVFLKMNSLQTDDTAIYYCAKHYYYGGSYAM DYWGQGTSVTVSSTTTPAPRPPTPAPTIASQPLSLRPEACRPAAGGAVHTR GLDFACDIYIWAPLAGTCGVLLLSLVITLYCKRGRKKLLYIFKQPFMRPV QTTQEEDGCSCRFPEEEEGGCELRVKFSRSADAPAYKQGQNQLYNELNL GRREEYDVLDKRRGRDPEMGGKPRRKNPQEGLYNELQKDKMAEAYSEI GMKGERRRGKGHDGLYQGLSTATKDTYDALHMQALPPRGSATNFSLLK QAGDVEENPGPMCHQQLVISWFSLVFLASPLVAIWELKKDVYVVELDW YPDAPGEMVVLTCDTPEEDGITWTLDQSSEVLGSGKTLTIQVKEFGDAGQ YTCHKGGEVLSHSLLLLHKKEDGIWSTDILKDQKEPKNKTFLRCEAKNYS GRFTCWWLTTISTDLTFSVKSSRGSSDPQGVTCGAATLSAERVRGDNKEY EYSVECQEDSACPAAEESLPIEVMVDAVHKLKYENYTSSFFIRDIIKPDPPK NLQLKPLKNSRQVEVSWEYPDTWSTPHSYFSLTFCVQVQGKSKREKKDR VFTDKTSATVICRKNASISVRAQDRYYSSSWSEWASVPCSGGGGSGGGGS GGGGSRNLPVATPDPGMFPCLHHSQNLLRAVSNMLQKARQTLEFYPCTS EEIDHEDITKDKTSTVEACLPLELTKNESCLNSRETSFITNGSCLASRKTSF MMALCLSSIYEDLKMYQVEFKTMNAKLLMDPKRQIFLDQNMLAVIDEL MQALNFNSETVPQKSSLEEPDFYKTKIKLCILLHAFRIRAVTIDRVMSYLN ASGSGSGSGSGSGSGSGSGSGSGSGSGSGSGSTTTPAPRPPTPAPTIASQPL SLRPEACRPAAGGAVHTRGLDFACDIYIWAPLAGTCGVLLLSLVITLYCG SSHHWGYGKHNGPEHWHKDFPIAKGELQSPVDIDTHTAKYDPSLKPLSV SYDQATSLRILNNGHAFNVEFDDSQDKAVLKGGPLDGIYRLIQFHFHWGS LDGQGSEHTVDKKKYAAELHLVYWNTKYGDFGKAVQQPDGLAVLGIFL KVGSAKPGLQKVVDVLDSIKTKGKSADFTNFDPRGLLPESLDYWTYPGS LTTPPLLECVTWIVLKEPISVSSEQVLKFRKLNFNGEGEPEELMVDNWRP AQPLKDRQIKASFK* | 5978 | 5979 |
| OT-001895 (Met; CD8a leader; CD19 scFv; CD8a Hinge and Transmembrane Domain; 4-1BB intracellular domain (CD28 co-stimulatory domain); CD3 zeta intracellular domain; Linker (GS); P2A Cleavage Site; IL12B leader; Interleukin-12 subunit beta (p40) (23-328 of WT); Linker (G4S)3; Interleukin-12 subunit alpha (p35) (57-253 of WT); Linker ((GS)15); | MALPVTALLLPLALLLHAARPDIQMTQTTSSLSASLGDRVTISCRASQDIS KYLNWYQQKPDGTVKLLIYHTSRLHSGVPSRFSGSGSGTDYSLTISNLEQ EDIATYFCQQGNTLPYTFGGGTKLEITGGGGSGGGGSGGGGSEVKLQESG PGLVAPSQSLSVTCTVSGVSLPDYGVSWIRQPPRKGLEWLGVIWGSETTY YNSALKSRLTIIKDNSKSQVFLKMNSLQTDDTAIYYCAKHYYYGGSYAM DYWGQGTSVTVSSTTTPAPRPPTPAPTIASQPLSLRPEACRPAAGGAVHTR GLDFACDIYIWAPLAGTCGVLLLSLVITLYCKRGRKKLLYIFKQPFMRPV QTTQEEDGCSCRFPEEEEGGCELRVKFSRSADAPAYKQGQNQLYNELNL GRREEYDVLDKRRGRDPEMGGKPRRKNPQEGLYNELQKDKMAEAYSEI GMKGERRRGKGHDGLYQGLSTATKDTYDALHMQALPPRGSATNFSLLK QAGDVEENPGPMCHQQLVISWFSLVFLASPLVAIWELKKDVYVVELDW YPDAPGEMVVLTCDTPEEDGITWTLDQSSEVLGSGKTLTIQVKEFGDAGQ YTCHKGGEVLSHSLLLLHKKEDGIWSTDILKDQKEPKNKTFLRCEAKNYS GRFTCWWLTTISTDLTFSVKSSRGSSDPQGVTCGAATLSAERVRGDNKEY EYSVECQEDSACPAAEESLPIEVMVDAVHKLKYENYTSSFFIRDIIKPDPPK NLQLKPLKNSRQVEVSWEYPDTWSTPHSYFSLTFCVQVQGKSKREKKDR VFTDKTSATVICRKNASISVRAQDRYYSSSWSEWASVPCSGGGGSGGGGS GGGGSRNLPVATPDPGMFPCLHHSQNLLRAVSNMLQKARQTLEFYPCTS EEIDHEDITKDKTSTVEACLPLELTKNESCLNSRETSFITNGSCLASRKTSF MMALCLSSIYEDLKMYQVEFKTMNAKLLMDPKRQIFLDQNMLAVIDEL | 6057 | 6058 |

TABLE 9-continued

CA2 mbIL2 with CAR constructs

| ID | AA Sequence | AA SEQ ID NO. | NA SEQ ID NO. |
|---|---|---|---|
| CD8a Hinge and Transmembrane Domain; Linker (GS); stop) | MQALNFNSETVPQKSSLEEPDFYKTKIKLCILLHAFRIRAVTIDRVMSYLN ASGSGSGSGSGSGSGSGSGSGSGSGSGSGSTTTPAPRPPTPAPTIASQPL SLRPEACRPAAGGAVHTRGLDFACDIYIWAPLAGTCGVLLLSLVITLYCG S* | | |
| OT-002113 (Met; CD8a Leader; CD19 scFV; CD8a Hinge and Transmembrane Domain; 4-1BB intracellular signaling domain; CD3 zeta signaling domain; Linker (GS); P2A cleavage site; Met; Interleukin-12 subunit beta (p40) Leader; IL12B (p40) (23-328 of WT); Linker ((G4S)3); IL12A (p35) (57-253 of WT); Linker (GS)15; CD8a hinge; CD8a Transmembrane Domain; Linker (GS); CA2 (aa 2-260 of WT); stop) | MALPVTALLLPLALLLHAARPDIQMTQTTSSLSASLGDRVTISCRASQDIS KYLNWYQQKPDGTVKLLIYHTSRLHSGVPSRFSGSGSGTDYSLTISNLEQ EDIATYFCQQGNTLPYTFGGGTKLEITGGGGSGGGGSGGGGSEVKLQESG PGLVAPSQSLSVTCTVSGVSLPDYGVSWIRQPPRKGLEWLGVIWGSETTY YNSALKSRLTIIKDNSKSQVFLKMNSLQTDDTAIYYCAKHYYYGGSYAM DYWGQGTSVTVSSTTTPAPRPPTPAPTIASQPLSLRPEACRPAAGGAVHTR GLDFACDIYIWAPLAGTCGVLLLSLVITLYCKRGRKKLLYIFKQPFMRPV QTTQEEDGCSCRFPEEEEGGCELRVKFSRSADAPAYKQGQNQLYNELNL GRREEYDVLDKRRGRDPEMGGKPRRKNPQEGLYNELQKDKMAEAYSEI GMKGERRRGKGHDGLYQGLSTATKDTYDALHMQALPPRGSATNFSLLK QAGDVEENPGPMCHQQLVISWFSLVFLASPLVAIWELKKDVYVVELDW YPDAPGEMVVLTCDTPEEDGITWTLDQSSEVLGSGKTLTIQVKEFGDAGQ YTCHKGGEVLSHSLLLLHKKEDGIWSTDILKDQKEPKNKTFLRCEAKNYS GRFTCWWLTTISTDLTFSVKSSRGSSDPQGVTCGAATLSAERVRGDNKEY EYSVECQEDSACPAAEESLPIEVMVDAVHKLKYENYTSSFFIRDIIKPDPPK NLQLKPLKNSRQVEVSWEYPDTWSTPHSYFSLTFCVQVQGKSKREKKDR VFTDKTSATVICRKNASISVRAQDRYYSSSWSEWASVPCSGGGGSGGGGS GGGGSRNLPVATPDPGMFPCLHHSQNLLRAVSNMLQKARQTLEFYPCTS EEIDHEDITKDKTSTVEACLPLELTKNESCLNSRETSFITNGSCLASRKTSF MMALCLSSIYEDLKMYQVEFKTMNAKLLMDPKRQIFLDQNMLAVIDEL MQALNFNSETVPQKSSLEEPDFYKTKIKLCILLHAFRIRAVTIDRVMSYLN ASGSGSGSGSGSGSGSGSGSGSGSGSGSGSTTTPAPRPPTPAPTIASQPL SLRPEACRPAAGGAVHTRGLDFACDIYIWAPLAGTCGVLLLSLVITLYCG SSHHWGYGKHNGPEHWHKDFPIAKGERQSPVDIDTHTAKYDPSLKPLSV SYDQATSLRILNNGHAFNVEFDDSQDKAVLKGGPLDGTYRLIQFHFHWG SLDGQGSEHTVDKKKYAAELHLVHWNTKYGDFGKAVQQPDGLAVLGIF LKVGSAKPGLQKVVDVLDSIKTKGKSADFTNFDPRGLLPESLDYWTYPG SLTTPPLLECVTWIVLKEPISVSSEQVLKFRKLNFNGEGEPEELMVDNWRP AQPLKNRQIKASFK* | 6059 | 6060 |
| OT-002097 (Met; CD8a Leader; CD19 scFV; CD8a Hinge and Transmembrane Domain; 4-1BB intracellular signaling domain; CD3 zeta signaling domain; Linker (GS); P2A cleavage site; Met; Interleukin-12 subunit beta (p40) Leader; IL12B (p40) (23-328 of WT); Linker ((G4S)3); IL12A (p35) (57-253 of WT); Linker (GSGSGSGS); B7-1 C2 domain; B7-1 Transmembrane Domain; B7-1 Tail; Linker (GS); CA2 (aa 2-260 of WT, L156H); stop) | MALPVTALLLPLALLLHAARPDIQMTQTTSSLSASLGDRVTISCRASQDIS KYLNWYQQKPDGTVKLLIYHTSRLHSGVPSRFSGSGSGTDYSLTISNLEQ EDIATYFCQQGNTLPYTFGGGTKLEITGGGGSGGGGSGGGGSEVKLQESG PGLVAPSQSLSVTCTVSGVSLPDYGVSWIRQPPRKGLEWLGVIWGSETTY YNSALKSRLTIIKDNSKSQVFLKMNSLQTDDTAIYYCAKHYYYGGSYAM DYWGQGTSVTVSSTTTPAPRPPTPAPTIASQPLSLRPEACRPAAGGAVHTR GLDFACDIYIWAPLAGTCGVLLLSLVITLYCKRGRKKLLYIFKQPFMRPV QTTQEEDGCSCRFPEEEEGGCELRVKFSRSADAPAYKQGQNQLYNELNL GRREEYDVLDKRRGRDPEMGGKPRRKNPQEGLYNELQKDKMAEAYSEI GMKGERRRGKGHDGLYQGLSTATKDTYDALHMQALPPRGSATNFSLLK QAGDVEENPGPMCHQQLVISWFSLVFLASPLVAIWELKKDVYVVELDW YPDAPGEMVVLTCDTPEEDGITWTLDQSSEVLGSGKTLTIQVKEFGDAGQ YTCHKGGEVLSHSLLLLHKKEDGIWSTDILKDQKEPKNKTFLRCEAKNYS GRFTCWWLTTISTDLTFSVKSSRGSSDPQGVTCGAATLSAERVRGDNKEY EYSVECQEDSACPAAEESLPIEVMVDAVHKLKYENYTSSFFIRDIIKPDPPK NLQLKPLKNSRQVEVSWEYPDTWSTPHSYFSLTFCVQVQGKSKREKKDR VFTDKTSATVICRKNASISVRAQDRYYSSSWSEWASVPCSGGGGSGGGGS GGGGSRNLPVATPDPGMFPCLHHSQNLLRAVSNMLQKARQTLEFYPCTS EEIDHEDITKDKTSTVEACLPLELTKNESCLNSRETSFITNGSCLASRKTSF MMALCLSSIYEDLKMYQVEFKTMNAKLLMDPKRQIFLDQNMLAVIDEL MQALNFNSETVPQKSSLEEPDFYKTKIKLCILLHAFRIRAVTIDRVMSYLN ASGSGSGSGSADFPTPSISDFEIPTSNIRRIICSTSGGFPEPHLSWLENGEELN AINTTVSQDPETELYAVSSKLDFNMTTNHSFMCLIKYGHLRVNQTFNWN TTKQEHFPDNLLPSWAITLISVNGIFVICCLTYCFAPRCRERRGSSHHWGY GKHNGPEHWHKDFPIAKGERQSPVDIDTHTAKYDPSLKPLSVSYDQATSL RILNNGHAFNVEFDDSQDKAVLKGGPLDGTYRLIQFHFHWGSLDGQGSE HTVDKKKYAAELHLVHWNTKYGDFGKAVQQPDGLAVLGIFLKVGSAKP GHQKVVDVLDSIKTKGKSADFTNFDPRGLLPESLDYWTYPGSLTTPPLLE CVTWIVLKEPISVSSEQVLKFRKLNFNGEGEPEELMVDNWRPAQPLKNRQ IKASFK* | 6061 | 6062 |
| OT-002098 (Met; CD8a Leader; CD19 scFV; CD8a Hinge and Transmembrane Domain; 4-1BB intracellular signaling domain; | MALPVTALLLPLALLLHAARPDIQMTQTTSSLSASLGDRVTISCRASQDIS KYLNWYQQKPDGTVKLLIYHTSRLHSGVPSRFSGSGSGTDYSLTISNLEQ EDIATYFCQQGNTLPYTFGGGTKLEITGGGGSGGGGSGGGGSEVKLQESG PGLVAPSQSLSVTCTVSGVSLPDYGVSWIRQPPRKGLEWLGVIWGSETTY YNSALKSRLTIIKDNSKSQVFLKMNSLQTDDTAIYYCAKHYYYGGSYAM DYWGQGTSVTVSSTTTPAPRPPTPAPTIASQPLSLRPEACRPAAGGAVHTR GLDFACDIYIWAPLAGTCGVLLLSLVITLYCKRGRKKLLYIFKQPFMRPV | 6063 | 6064 |

CA2 mbIL2 with CAR constructs

| ID | AA Sequence | AA SEQ ID NO. | NA SEQ ID NO. |
|---|---|---|---|
| CD3 zeta signaling domain; Linker (GS); P2A cleavage site; Met; Interleukin-12 subunit beta (p40) Leader; IL12B (p40) (23-328 of WT); Linker ((G4S)3); IL12A (p35) (57-253 of WT); Linker (GSGSGSGS); IgG1 Fc; B7-1 Transmembrane Domain; B7-1 Tail; Linker (GS); CA2 (aa 2-260 of WT, L156H); stop) | QTTQEEDGCSCRFPEEEEGGCELRVKFSRSADAPAYKQGQNQLYNELNL GRREEYDVLDKRRGRDPEMGGKPRRKNPQEGLYNELQKDKMAEAYSEI GMKGERRRGKGHDGLYQGLSTATKDTYDALHMQALPPRGSATNFSLLK QAGDVEENPGPMCHQQLVISWFSLVFLASPLVAIWELKKDVYVVELDW YPDAPGEMVVLTCDTPEEDGITWTLDQSSEVLGSGKTLTIQVKEFGDAGQ YTCHKGGEVLSHSLLLLHKKEDGIWSTDILKDQKEPKNKTFLRCEAKNYS GRFTCWWLTTISTDLTFSVKSSRGSSDPQGVTCGAATLSAERVRGDNKEY EYSVECQEDSACPAAEESLPIEVMVDAVHKLKYENYTSSFFIRDIIKPDPPK NLQLKPLKNSRQVEVSWEYPDTWSTPHSYFSLTFCVQVQGKSKREKKDR VFTDKTSATVICRKNASISVRAQDRYYSSSWSEWASVPCSGGGGSGGGGS GGGGSRNLPVATPDPGMFPCLHHSQNLLRAVSNMLQKARQTLEFYPCTS EEIDHEDITKDKTSTVEACLPLELTKNESCLNSRETSFITNGSCLASRKTSF MMALCLSSIYEDLKMYQVEFKTMNAKLLMDPKRQIFLDQNMLAVIDEL MQALNFNSETVPQKSSLEEPDFYKTKIKLCILLHAFRIRAVTIDRVMSYLN ASGSGSGSGSGSDKTHTCPPCPAPELLGGPSVFLFPPKPKDTLMISRTPEVTCV VVDVSHEDPEVKFNWYVDGVEVHNAKTKPREEQYNSTYRVVSVLTVLH QDWLNGKEYKCKVSNKALPAPIEKTISKAKGQPREPQVYTLPPSRDELTK NQVSLTCLVKGFYPSDIAVEWESNGQPENNYKTTPPVLDSDGSFFLYSKL TVDKSRWQQGNVFSCSVMHEALHNHYTQKSLSLSPGKKQEHFPDNLLPS WAITLISVNGIFVICCLTYCFAPRCRERRGSSHHWGYGKHNGPEHWHKDF PTAKGERQSPVDIDTHTAKYDPSLKPLSVSYDQATSLRILNNGHAFNVEFD DSQDKAVLKGGPLDGTYRLIQFHFHWGSLDGQGSEHTVDKKKYAAELH LVHWNTKYGDFGKAVQQPDGLAVLGIFLKVGSAKPGHQKVVDVLDSIK TKGKSADFTNFDPRGLLPESLDYWTYPGSLTTPPLLECVTWIVLKEPISVS SEQVLKFRKLNFNGEGEPEELMVDNWRPAQPLKNRQIKASFK* | | |
| OT-002099 (Met; CD8a Leader; CD19 scFV; CD8a Hinge and Transmembrane Domain; 4-1BB intracellular signaling domain; CD3 zeta signaling domain; Linker (GS); P2A cleavage site; Met; Interleukin-12 subunit beta (p40) Leader; IL12B (p40) (23-328 of WT); Linker ((G4S)3); IL12A (p35) (57-253 of WT); Linker (GSGSGSGS); FCgr2b Hinge; B7-1 Transmembrane Domain; B7-1 Tail; Linker (GS); CA2 (aa 2-260 of WT, L156H); stop) | MALPVTALLLPLALLLHAARPDIQMTQTTSSLSASLGDRVTISCRASQDIS KYLNWYQQKPDGTVKLLIYHTSRLHSGVPSRFSGSGSGTDYSLTISNLEQ EDIATYFCQQGNTLPYTFGGGTKLEITGGGGSGGGGSGGGGSEVKLQESG PGLVAPSQSLSVTCTVSGVSLPDYGVSWIRQPPRKGLEWLGVIWGSETTY YNSALKSRLTIIKDNSKSQVFLKMNSLQTDDTAIYYCAKHYYYGGSYAM DYWGQGTSVTVSSTTTPAPRPPTPAPTIASQPLSLRPEACRPAAGGAVHTR GLDFACDIYIWAPLAGTCGVLLLSLVITLYCKRGRKKLLYIFKQPFMRPV QTTQEEDGCSCRFPEEEEGGCELRVKFSRSADAPAYKQGQNQLYNELNL GRREEYDVLDKRRGRDPEMGGKPRRKNPQEGLYNELQKDKMAEAYSEI GMKGERRRGKGHDGLYQGLSTATKDTYDALHMQALPPRGSATNFSLLK QAGDVEENPGPMCHQQLVISWFSLVFLASPLVAIWELKKDVYVVELDW YPDAPGEMVVLTCDTPEEDGITWTLDQSSEVLGSGKTLTIQVKEFGDAGQ YTCHKGGEVLSHSLLLLHKKEDGIWSTDILKDQKEPKNKTFLRCEAKNYS GRFTCWWLTTISTDLTFSVKSSRGSSDPQGVTCGAATLSAERVRGDNKEY EYSVECQEDSACPAAEESLPIEVMVDAVHKLKYENYTSSFFIRDIIKPDPPK NLQLKPLKNSRQVEVSWEYPDTWSTPHSYFSLTFCVQVQGKSKREKKDR VFTDKTSATVICRKNASISVRAQDRYYSSSWSEWASVPCSGGGGSGGGGS GGGGSRNLPVATPDPGMFPCLHHSQNLLRAVSNMLQKARQTLEFYPCTS EEIDHEDITKDKTSTVEACLPLELTKNESCLNSRETSFITNGSCLASRKTSF MMALCLSSIYEDLKMYQVEFKTMNAKLLMDPKRQIFLDQNMLAVIDEL MQALNFNSETVPQKSSLEEPDFYKTKIKLCILLHAFRIRAVTIDRVMSYLN ASGSGSGSGSGSFSIPQANHSHSGDYHCTGNIGYTLYSSKPVTITVQAPLLPS WAITLISVNGIFVICCLTYCFAPRCRERRGSSHHWGYGKHNGPEHWHKDF PTAKGERQSPVDIDTHTAKYDPSLKPLSVSYDQATSLRILNNGHAFNVEFD DSQDKAVLKGGPLDGTYRLIQFHFHWGSLDGQGSEHTVDKKKYAAELH LVHWNTKYGDFGKAVQQPDGLAVLGIFLKVGSAKPGHQKVVDVLDSIK TKGKSADFTNFDPRGLLPESLDYWTYPGSLTTPPLLECVTWIVLKEPISVS SEQVLKFRKLNFNGEGEPEELMVDNWRPAQPLKNRQIKASFK* | 6065 | 6066 |
| OT-002171 (Met; CD8a leader; CD19 scFv; CD8a hinge-TM; 4-1BB intracellular signaling domain; CD3 zeta signaling domain; Linker (GS); P2A cleavage site; Met; Interleukin-12 subunit beta (p40) leader; Interleukin-12 subunit beta (p40) (23-328 of WT); Linker ((G4S)3); Interleukin-12 subunit alpha (p35) (57-253 of WT); | MALPVTALLLPLALLLHAARPDIQMTQTTSSLSASLGDRVTISCRASQDIS KYLNWYQQKPDGTVKLLIYHTSRLHSGVPSRFSGSGSGTDYSLTISNLEQ EDIATYFCQQGNTLPYTFGGGTKLEITGGGGSGGGGSGGGGSEVKLQESG PGLVAPSQSLSVTCTVSGVSLPDYGVSWIRQPPRKGLEWLGVIWGSETTY YNSALKSRLTIIKDNSKSQVFLKMNSLQTDDTAIYYCAKHYYYGGSYAM DYWGQGTSVTVSSTTTPAPRPPTPAPTIASQPLSLRPEACRPAAGGAVHTR GLDFACDIYIWAPLAGTCGVLLLSLVITLYCKRGRKKLLYIFKQPFMRPV QTTQEEDGCSCRFPEEEEGGCELRVKFSRSADAPAYKQGQNQLYNELNL GRREEYDVLDKRRGRDPEMGGKPRRKNPQEGLYNELQKDKMAEAYSEI GMKGERRRGKGHDGLYQGLSTATKDTYDALHMQALPPRGSATNFSLLK QAGDVEENPGPMCHQQLVISWFSLVFLASPLVAIWELKKDVYVVELDW YPDAPGEMVVLTCDTPEEDGITWTLDQSSEVLGSGKTLTIQVKEFGDAGQ YTCHKGGEVLSHSLLLLHKKEDGIWSTDILKDQKEPKNKTFLRCEAKNYS GRFTCWWLTTISTDLTFSVKSSRGSSDPQGVTCGAATLSAERVRGDNKEY EYSVECQEDSACPAAEESLPIEVMVDAVHKLKYENYTSSFFIRDIIKPDPPK NLQLKPLKNSRQVEVSWEYPDTWSTPHSYFSLTFCVQVQGKSKREKKDR VFTDKTSATVICRKNASISVRAQDRYYSSSWSEWASVPCSGGGGSGGGGS GGGGSRNLPVATPDPGMFPCLHHSQNLLRAVSNMLQKARQTLEFYPCTS | 6067 | 6068 |

TABLE 9-continued

| | | AA SEQ ID NO. | NA SEQ ID NO. |
|---|---|---|---|
| | CA2 mbIL2 with CAR constructs | | |
| ID | AA Sequence | | |
| Linker ((GS)15); CD8a Hinge; B7-1 Transmembrane domain; B7-1 Tail; Linker (GS); CA2 (aa 2-260 of WT, L156H); stop) | EEIDHEDITKDKTSTVEACLPLELTKNESCLNSRETSFITNGSCLASRKTSF MMALCLSSIYEDLKMYQVEFKTMNAKLLMDPKRQIFLDQNMLAVIDEL MQALNFNSETVPQKSSLEEPDFYKTKIKLCILLHAFRIRAVTIDRVMSYLN ASGSGSGSGSGSGSGSGSGSGSGSGSGSGSGSLDFACDLLPSWAITLISVN GIFVICCLTYCFAPRCRERRGSSHHWGYGKHNGPEHWHKDFPIAKGERQS PVDIDTHTAKYDPSLKPLSVSYDQATSLRILNNGHAFNVEFDDSQDKAVL KGGPLDGTYRLIQFHFHWGSLDGQGSEHTVDKKKYAAELHLVHWNTKY GDFGKAVQQPDGLAVLGIFLKVGSAKPGHQKVVDVLDSIKTKGKSADFT NFDPRGLLPESLDYWTYPGSLTTPPLLECVTWIVLKEPISVSSEQVLKFRK LNFNGEGEPEELMVDNWRPAQPLKNRQIKASFK* | | |
| OT-002166 (Met; CD8a leader; CD19 scFv; CD8a hinge-TM; 4-1BB intracellular signaling domain; CD3 zeta signaling domain; Linker (GS); P2A cleavage site; Met; Interleukin-12 subunit beta (p40) leader; Interleukin-12 subunit beta (p40) (23-328 of WT); Linker ((G4S)3); Interleukin-12 subunit alpha (p35) (57-253 of WT); Linker ((GS)15); CD8a hinge-TM; Linker (GS); CA2 (aa 2-260 of WT, L156H, S172C, F178Y, E186D); stop) | MALPVTALLLPLALLLHAARPDIQMTQTTSSLSASLGDRVTISCRASQDIS KYLNWYQQKPDGTVKLLIYHTSRLHSGVPSRFSGSGSGTDYSLTISNLEQ EDIATYFCQQGNTLPYTFGGGTKLEITGGGGSGGGGSGGGGSEVKLQESG PGLVAPSQSLSVTCTVSGVSLPDYGVSWIRQPPRKGLEWLGVIWGSETTY YNSALKSRLTIIKDNSKSQVFLKMNSLQTDDTAIYYCAKHYYYGGSYAM DYWGQGTSVTVSSTTTPAPRPPTPAPTIASQPLSLRPEACRPAAGGAVHTR GLDFACDIYIWAPLAGTCGVLLLSLVITLYCKRGRKKLLYIFKQPFMRPV QTTQEEDGCSCRFPEEEEGGCELRVKFSRSADAPAYKQGQNQLYNELNL GRREEYDVLDKRRGRDPEMGGKPRRKNPQEGLYNELQKDKMAEAYSEI GMKGERRRGKGHDGLYQGLSTATKDTYDALHMQALPPRGSATNFSLLK QAGDVEENPGPMCHQQLVISWFSLVFLASPLVAIWELKKDVYVVELDW YPDAPGEMVVLTCDTPEEDGITWTLDQSSEVLGSGKTLTIQVKEFGDAGQ YTCHKGGEVLSHSLLLLHKKEDGIWSTDILKDQKEPKNKTFLRCEAKNYS GRFTCWWLTTISTDLTFSVKSSRGSSDPQGVTCGAATLSAERVRGDNKEY EYSVECQEDSACPAAEESLPIEVMVDAVHKLKYENYTSSFFIRDIIKPDPPK NLQLKPLKNSRQVEVSWEYPDTWSTPHSYFSLTFCVQVQGKSKREKKDR VFTDKTSATVICRKNASISVRAQDRYYSSSWSEWASVPCSGGGGSGGGGS GGGGSRNLPVATPDPGMPCLHHSQNLLRAVSNMLQKARQTLEFYPCTS EEIDHEDITKDKTSTVEACLPLELTKNESCLNSRETSFITNGSCLASRKTSF MMALCLSSIYEDLKMYQVEFKTMNAKLLMDPKRQIFLDQNMLAVIDEL MQALNFNSETVPQKSSLEEPDFYKTKIKLCILLHAFRIRAVTIDRVMSYLN ASGSGSGSGSGSGSGSGSGSGSGSGSGSGSGSTTTPAPRPPTPAPTIASQPL SLRPEACRPAAGGAVHTRGLDFACDIYIWAPLAGTCGVLLLSLVITLYCG SSHHWGYGKHNGPEHWHKDFPIAKGERQSPVDIDTHTAKYDPSLKPLSV SYDQATSLRILNNGHAFNVEFDDSQDKAVLKGGPLDGTYRLIQFHFHWG SLDGQGSEHTVDKKKYAAELHLVHWNTKYGDFGKAVQQPDGLAVLGIF LKVGSAKPGHQKVVDVLDSIKTKGKCADFTNYDPRGLLPDSLDYWTYPG SLTTPPLLECVTWIVLKEPISVSSEQVLKFRKLNFNGEGEPEELMVDNWRP AQPLKNRQIKASFK* | 6069 | 6070 |
| OT-002167 (Met; CD8a leader; CD19 scFv; CD8a hinge-TM; 4-1BB intracellular signaling domain; CD3 zeta signaling domain; Linker (GS); P2A cleavage site; Met; Interleukin-12 subunit beta (p40) leader; Interleukin-12 subunit beta (p40) (23-328 of WT); Linker ((G4S)3); Interleukin-12 subunit alpha (p35) (57-253 of WT); Linker ((GS)15); CD8a hinge-TM; Linker (GS); CA2 (aa 2-260 of WT, D72F, V241F, P249L); stop) | MALPVTALLLPLALLLHAARPDIQMTQTTSSLSASLGDRVTISCRASQDIS KYLNWYQQKPDGTVKLLIYHTSRLHSGVPSRFSGSGSGTDYSLTISNLEQ EDIATYFCQQGNTLPYTFGGGTKLEITGGGGSGGGGSGGGGSEVKLQESG PGLVAPSQSLSVTCTVSGVSLPDYGVSWIRQPPRKGLEWLGVIWGSETTY YNSALKSRLTIIKDNSKSQVFLKMNSLQTDDTAIYYCAKHYYYGGSYAM DYWGQGTSVTVSSTTTPAPRPPTPAPTIASQPLSLRPEACRPAAGGAVHTR GLDFACDIYIWAPLAGTCGVLLLSLVITLYCKRGRKKLLYIFKQPFMRPV QTTQEEDGCSCRFPEEEEGGCELRVKFSRSADAPAYKQGQNQLYNELNL GRREEYDVLDKRRGRDPEMGGKPRRKNPQEGLYNELQKDKMAEAYSEI GMKGERRRGKGHDGLYQGLSTATKDTYDALHMQALPPRGSATNFSLLK QAGDVEENPGPMCHQQLVISWFSLVFLASPLVAIWELKKDVYVVELDW YPDAPGEMVVLTCDTPEEDGITWTLDQSSEVLGSGKTLTIQVKEFGDAGQ YTCHKGGEVLSHSLLLLHKKEDGIWSTDILKDQKEPKNKTFLRCEAKNYS GRFTCWWLTTISTDLTFSVKSSRGSSDPQGVTCGAATLSAERVRGDNKEY EYSVECQEDSACPAAEESLPIEVMVDAVHKLKYENYTSSFFIRDIIKPDPPK NLQLKPLKNSRQVEVSWEYPDTWSTPHSYFSLTFCVQVQGKSKREKKDR VFTDKTSATVICRKNASISVRAQDRYYSSSWSEWASVPCSGGGGSGGGGS GGGGSRNLPVATPDPGMPCLHHSQNLLRAVSNMLQKARQTLEFYPCTS EEIDHEDITKDKTSTVEACLPLELTKNESCLNSRETSFITNGSCLASRKTSF MMALCLSSIYEDLKMYQVEFKTMNAKLLMDPKRQIFLDQNMLAVIDEL MQALNFNSETVPQKSSLEEPDFYKTKIKLCILLHAFRIRAVTIDRVMSYLN ASGSGSGSGSGSGSGSGSGSGSGSGSGSGSGSTTTPAPRPPTPAPTIASQPL SLRPEACRPAAGGAVHTRGLDFACDIYIWAPLAGTCGVLLLSLVITLYCG SSHHWGYGKHNGPEHWHKDFPIAKGERQSPVDIDTHTAKYDPSLKPLSV SYDQATSLRILNNGHAFNVEFDFSQDKAVLKGGPLDGTYRLIQFHFHWGS LDGQGSEHTVDKKKYAAELHLVHWNTKYGDFGKAVQQPDGLAVLGIFL KVGSAKPGLQKVVDVLDSIKTKGKSADFTNFDPRGLLPESLDYWTYPGS LTTPPLLECVTWIVLKEPISVSSEQVLKFRKLNFNGEGEPEELMFDNWRPA QLLKNRQIKASFK* | 6071 | 6072 |

TABLE 9-continued

| | CA2 mbIL2 with CAR constructs | | |
| | | AA SEQ ID NO. | NA SEQ ID NO. |
| ID | AA Sequence | | |
| --- | --- | --- | --- |
| OT-002007 (Met; CD8a leader; CD19 scFv; CD8a hinge-TM; 4-1BB intracellular signaling domain; CD3 zeta signaling domain; Linker (GS); P2A cleavage site; Met; Interleukin-12 subunit beta (p40) leader; Interleukin-12 subunit beta (p40) (23-328 of WT); Linker ((G4S)3); Interleukin-12 subunit alpha (p35) (57-253 of WT); Linker ((GS)15); CD8a hinge-TM; Linker (GS); CA2 (aa 2-260 of WT, I59N, G102R); stop) | MALPVTALLLPLALLLHAARPDIQMTQTTSSLSASLGDRVTISCRASQDIS KYLNWYQQKPDGTVKLLIYHTSRLHSGVPSRFSGSGSGTDYSLTISNLEQ EDIATYFCQQGNTLPYTFGGGTKLEITGGGGSGGGGSGGGGSEVKLQESG PGLVAPSQSLSVTCTVSGVSLPDYGVSWIRQPPRKGLEWLGVIWGSETTY YNSALKSRLTIIKDNSKSQVFLKMNSLQTDDTAIYYCAKHYYYGGSYAM DYWGQGTSVTVSSTTTPAPRPPTPAPTIASQPLSLRPEACRPAAGGAVHTR GLDFACDIYIWAPLAGTCGVLLLSLVITLYCKRGRKKLLYIFKQPFMRPV QTTQEEDGCSCRFPEEEEGGCELRVKFSRSADAPAYKQGQNQLYNELNL GRREEYDVLDKRRGRDPEMGGKPRRKNPQEGLYNELQKDKMAEAYSEI GMKGERRRGKGHDGLYQGLSTATKDTYDALHMQALPPRGSATNFSLLK QAGDVEENPGPMCHQQLVISWFSLVFLASPLVAIWELKKDVYVVELDW YPDAPGEMVVLTCDTPEEDGITWTLDQSSEVLGSGKTLTIQVKEFGDAGQ YTCHKGGEVLSHSLLLLHKKEDGIWSTDILKDQKEPKNKTFLRCEAKNYS GRFTCWWLTTISTDLTFSVKSSRGSSDPQGVTCGAATLSAERVRGDNKEY EYSVECQEDSACPAAEESLPIEVMVDAVHKLKYENYTSSFFIRDIIKPDPPK NLQLKPLKNSRQVEVSWEYPDTWSTPHSYFSLTFCVQVQGKSKREKKDR VFTDKTSATVICRKNASISVRAQDRYYSSSWSEWASVPCSGGGGSGGGGS GGGGSRNLPVATPDPGMFPCLHHSQNLLRAVSNMLQKARQTLEFYPCTS EEIDHEDITKDKTSTVEACLPLELTKNESCLNSRETSFITNGSCLASRKTSF MMALCLSSIYEDLKMYQVEFKTMNAKLLMDPKRQIFLDQNMLAVIDEL MQALNFNSETVPQKSSLEEPDFYKTKILCILLHAFRIRAVTIDRVMSYLN ASGSGSGSGSGSGSGSGSGSGSGSGSGSGSGSTTTPAPRPPTPAPTIASQPL SLRPEACRPAAGGAVHTRGLDFACDIYIWAPLAGTCGVLLLSLVITLYCG SSHHWGYGKHNGPEHWHKDFPIAKGERQSPVDIDTHTAKYDPSLKPLSV SYDQATSLRNLNNGHAFNVEFDDSQDKAVLKGGPLDGTYRLIQPHFHWG SLDRQGSEHTVDKKKYAAELHLVHWNTKYGDFGKAVQQPDGLAVLGIF LKVGSAKPGLQKVVDVLDSIKTKGKSADFTNFDPRGLLPESLDYWTYPG SLTTPPLLECVTWIVLKEPISVSSEQVLKFRKLNFNGEGEPEELMVDNWRP AQPLKNRQIKASFK* | 6073 | 6074 |
| OT-002008 (Met; CD8a leader; CD19 scFv; CD8a hinge-TM; 4-1BB intracellular signaling domain; CD3 zeta signaling domain; Linker (GS); P2A cleavage site; Met; Interleukin-12 subunit beta (p40) leader; Interleukin-12 subunit beta (p40) (23-328 of WT); Linker ((G4S)3); Interleukin-12 subunit alpha (p35) (57-253 of WT); Linker ((GS)15); CD8a hinge-TM; Linker (GS); CA2 (aa 2-260 of WT, L156H); stop) | MALPVTALLLPLALLLHAARPDIQMTQTTSSLSASLGDRVTISCRASQDIS KYLNWYQQKPDGTVKLLIYHTSRLHSGVPSRFSGSGSGTDYSLTISNLEQ EDIATYFCQQGNTLPYTFGGGTKLEITGGGGSGGGGSGGGGSEVKLQESG PGLVAPSQSLSVTCTVSGVSLPDYGVSWIRQPPRKGLEWLGVIWGSETTY YNSALKSRLTIIKDNSKSQVFLKMNSLQTDDTAIYYCAKHYYYGGSYAM DYWGQGTSVTVSSTTTPAPRPPTPAPTIASQPLSLRPEACRPAAGGAVHTR GLDFACDIYIWAPLAGTCGVLLLSLVITLYCKRGRKKLLYIFKQPFMRPV QTTQEEDGCSCRFPEEEEGGCELRVKFSRSADAPAYKQGQNQLYNELNL GRREEYDVLDKRRGRDPEMGGKPRRKNPQEGLYNELQKDKMAEAYSEI GMKGERRRGKGHDGLYQGLSTATKDTYDALHMQALPPRGSATNFSLLK QAGDVEENPGPMCHQQLVISWFSLVFLASPLVAIWELKKDVYVVELDW YPDAPGEMVVLTCDTPEEDGITWTLDQSSEVLGSGKTLTIQVKEFGDAGQ YTCHKGGEVLSHSLLLLHKKEDGIWSTDILKDQKEPKNKTFLRCEAKNYS GRFTCWWLTTISTDLTFSVKSSRGSSDPQGVTCGAATLSAERVRGDNKEY EYSVECQEDSACPAAEESLPIEVMVDAVHKLKYENYTSSFFIRDIIKPDPPK NLQLKPLKNSRQVEVSWEYPDTWSTPHSYFSLTFCVQVQGKSKREKKDR VFTDKTSATVICRKNASISVRAQDRYYSSSWSEWASVPCSGGGGSGGGGS GGGGSRNLPVATPDPGMFPCLHHSQNLLRAVSNMLQKARQTLEFYPCTS EEIDHEDITKDKTSTVEACLPLELTKNESCLNSRETSFITNGSCLASRKTSF MMALCLSSIYEDLKMYQVEFKTMNAKLLMDPKRQIFLDQNMLAVIDEL MQALNFNSETVPQKSSLEEPDFYKTKIKLCILLHAFRIRAVTIDRVMSYLN ASGSGSGSGSGSGSGSGSGSGSGSGSGSGSGSTTTPAPRPPTPAPTIASQPL SLRPEACRPAAGGAVHTRGLDFACDIYIWAPLAGTCGVLLLSLVITLYCG SSHHWGYGKHNGPEHWHKDFPIAKGERQSPVDIDTHTAKYDPSLKPLSV SYDQATSLRILNNGHAFNVEFDDSQDKAVLKGGPLDGTYRLIQPHFHWG SLDGQGSEHTVDKKKYAAELHLVHWNTKYGDFGKAVQQPDGLAVLGIF LKVGSAKPGHQKVVDVLDSIKTKGKSADFTNFDPRGLLPESLDYWTYPG SLTTPPLLECVTWIVLKEPISVSSEQVLKFRKLNFNGEGEPEELMVDNWRP AQPLKNRQIKASFK* | 6075 | 6076 |
| OT-002171 (Met; CD8a leader; CD19 scFv; CD8a hinge-TM; 4-1BB intracellular signaling domain; CD3 zeta signaling domain; Linker (GS); P2A cleavage site; Met; Interleukin-12 subunit beta (p40) leader; Interleukin- | MALPVTALLLPLALLLHAARPDIQMTQTTSSLSASLGDRVTISCRASQDIS KYLNWYQQKPDGTVKLLIYHTSRLHSGVPSRFSGSGSGTDYSLTISNLEQ EDIATYFCQQGNTLPYTFGGGTKLEITGGGGSGGGGSGGGGSEVKLQESG PGLVAPSQSLSVTCTVSGVSLPDYGVSWIRQPPRKGLEWLGVIWGSETTY YNSALKSRLTIIKDNSKSQVFLKMNSLQTDDTAIYYCAKHYYYGGSYAM DYWGQGTSVTVSSTTTPAPRPPTPAPTIASQPLSLRPEACRPAAGGAVHTR GLDFACDIYIWAPLAGTCGVLLLSLVITLYCKRGRKKLLYIFKQPFMRPV QTTQEEDGCSCRFPEEEEGGCELRVKFSRSADAPAYKQGQNQLYNELNL GRREEYDVLDKRRGRDPEMGGKPRRKNPQEGLYNELQKDKMAEAYSEI GMKGERRRGKGHDGLYQGLSTATKDTYDALHMQALPPRGSATNFSLLK QAGDVEENPGPMCHQQLVISWFSLVFLASPLVAIWELKKDVYVVELDW YPDAPGEMVVLTCDTPEEDGITWTLDQSSEVLGSGKTLTIQVKEFGDAGQ | 6077 | 6078 |

TABLE 9-continued

CA2 mbIL2 with CAR constructs

| ID | AA Sequence | AA SEQ ID NO. | NA SEQ ID NO. |
|---|---|---|---|
| 12 subunit beta (p40) (23-328 of WT); Linker ((G4S)3); Interleukin-12 subunit alpha (p35) (57-253 of WT); Linker ((GS)15); CD8a Hinge; B7-1 Transmembrane domain; B7-1 Tail; Linker (GS); CA2 (aa 2-260 of WT, L156H); stop) | YTCHKGGEVLSHSLLLLHKKEDGIWSTDILKDQKEPKNKTFLRCEAKNYS GRFTCWWLTTISTDLTFSVKSSRGSSDPQGVTCGAATLSAERVRGDNKEY EYSVECQEDSACPAAEESLPIEVMVDAVHKLKYENYTSSFFIRDIIKPDPPK NLQLKPLKNSRQVEVSWEYPDTWSTPHSYFSLTFCVQVQGKSKREKKDR VFTDKTSATVICRKNASISVRAQDRYYSSSWSEWASVPCSGGGGSGGGGS GGGGSRNLPVATPDPGMFPCLHHSQNLLRAVSNMLQKARQTLEFYPCTS EEIDHEDITKDKTSTVEACLPLELTKNESCLNSRETSFITNGSCLASRKTSF MMALCLSSIYEDLKMYQVEFKTMNAKLLMDPKRQIFLDQNMLAVIDEL MQALNFNSETVPQKSSLEEPDFYKTKIKLCILLHAFRIRAVTIDRVMSYLN ASGSGSGSGSGSGSGSGSGSGSGSGSGSGSGSGSLDFACDLLPSWAITLISVN GIFVICCLTYCFAPRCERRGSSHHWGYGKHNGPEHWHKDFPIAKGERQS PVDIDTHTAKYDPSLKPLSVSYDQATSLRILNNGHAFNVEFDDSQDKAVL KGGPLDGTYRLIQFHFHWGSLDGQGSEHTVDKKKYAAELHLVHWNTKY GDFGKAVQQPDGLAVLGIFLKVGSAKPGHQKVVLDSIKTKGKSADFT NFDPRGLLPESLDYWTYPGSLTTPPLLECVTWIVLKEPISVSSEQVLKFRK LNFNGEGEPEELMVDNWRPAQPLKNRQIKASFK* | | |
| OT-002011 (Met; CD8a Leader; CD19 scFV; CD8a Hinge and Transmembrane Domain; 4-1BB intracellular signaling domain; CD3 zeta signaling domain; Linker (GS); P2A cleavage site; Met; Interleukin-12 subunit beta (p40) Leader; IL12B (p40) (23-328 of WT); Linker ((G4S)3); IL12A (p35) (57-253 of WT); Linker ((GS)15); CD8a Hinge; B7-1 Transmembrane Domain; B7-1 Tail; Linker (GS); stop) | MALPVTALLLPLALLLHAARPDIQMTQTTSSLSASLGDRVTISCRASQDIS KYLNWYQQKPDGTVKLLIYHTSRLHSGVPSRFSGSGSGTDYSLTISNLEQ EDIATYFCQQGNTLPYTFGGGTKLEITGGGGSGGGGSGGGGSEVKLQESG PGLVAPSQSLSVTCTVSGVSLPDYGVSWIRQPPRKGLEWLGVIWGSETTY YNSALKSRLTIIKDNSKSQVFLKMNSLQTDDTAIYYCAKHYYYGGSYAM DYWGQGTSVTVSSTTTPAPRPPTPAPTIASQPLSLRPEACRPAAGGAVHTR GLDFACDIYIWAPLAGTCGVLLLSLVITLYCKRGRKKLLYIFKQPFMRPV QTTQEEDGCSCRFPEEEEGGCELRVKFSRSADAPAYKQGQNQLYNELNL GRREEYDVLDKRRGRDPEMGGKPRRKNPQEGLYNELQKDKMAEAYSEI GMKGERRRGKGHDGLYQGLSTATKDTYDALHMQALPPRGSATNFSLLK QAGDVEENPGPMCHQQLVISWFSLVFLASPLVAIWELKKDVYVVELDW YPDAPGEMVVLTCDTPEEDGITWTLDQSSEVLGSGKTLTIQVKEFGDAGQ YTCHKGGEVLSHSLLLLHKKEDGIWSTDILKDQKEPKNKTFLRCEAKNYS GRFTCWWLTTISTDLTFSVKSSRGSSDPQGVTCGAATLSAERVRGDNKEY EYSVECQEDSACPAAEESLPIEVMVDAVHKLKYENYTSSFFIRDIIKPDPPK NLQLKPLKNSRQVEVSWEYPDTWSTPHSYFSLTFCVQVQGKSKREKKDR VFTDKTSATVICRKNASISVRAQDRYYSSSWSEWASVPCSGGGGSGGGGS GGGGSRNLPVATPDPGMFPCLHHSQNLLRAVSNMLQKARQTLEFYPCTS EEIDHEDITKDKTSTVEACLPLELTKNESCLNSRETSFITNGSCLASRKTSF MMALCLSSIYEDLKMYQVEFKTMNAKLLMDPKRQIFLDQNMLAVIDEL MQALNFNSETVPQKSSLEEPDFYKTKIKLCILLHAFRIRAVTIDRVMSYLN ASGSGSGSGSGSGSGSGSGSGSGSGSGSGSGSGSLDFACDLLPSWAITLISVN GIFVICCLTYCFAPRCERRGS* | 6079 | 6080 |
| OT-002111 (Met; CD8a Leader; CD19 scFV; CD8a Hinge and Transmembrane Domain; 4-1BB intracellular signaling domain; CD3 zeta signaling domain; Linker (GS); P2A cleavage site; Met; Interleukin-12 subunit beta (p40) Leader; IL12B (p40) (23-328 of WT); Linker ((G4S)3); IL12A (p35) (57-253 of WT); Linker (GSGSGSGS); B7-1 C2 domain; Linker (GS); stop) | MALPVTALLLPLALLLHAARPDIQMTQTTSSLSASLGDRVTISCRASQDIS KYLNWYQQKPDGTVKLLIYHTSRLHSGVPSRFSGSGSGTDYSLTISNLEQ EDIATYFCQQGNTLPYTFGGGTKLEITGGGGSGGGGSGGGGSEVKLQESG PGLVAPSQSLSVTCTVSGVSLPDYGVSWIRQPPRKGLEWLGVIWGSETTY YNSALKSRLTIIKDNSKSQVFLKMNSLQTDDTAIYYCAKHYYYGGSYAM DYWGQGTSVTVSSTTTPAPRPPTPAPTIASQPLSLRPEACRPAAGGAVHTR GLDFACDIYIWAPLAGTCGVLLLSLVITLYCKRGRKKLLYIFKQPFMRPV QTTQEEDGCSCRFPEEEEGGCELRVKFSRSADAPAYKQGQNQLYNELNL GRREEYDVLDKRRGRDPEMGGKPRRKNPQEGLYNELQKDKMAEAYSEI GMKGERRRGKGHDGLYQGLSTATKDTYDALHMQALPPRGSATNFSLLK QAGDVEENPGPMCHQQLVISWFSLVFLASPLVAIWELKKDVYVVELDW YPDAPGEMVVLTCDTPEEDGITWTLDQSSEVLGSGKTLTIQVKEFGDAGQ YTCHKGGEVLSHSLLLLHKKEDGIWSTDILKDQKEPKNKTFLRCEAKNYS GRFTCWWLTTISTDLTFSVKSSRGSSDPQGVTCGAATLSAERVRGDNKEY EYSVECQEDSACPAAEESLPIEVMVDAVHKLKYENYTSSFFIRDIIKPDPPK NLQLKPLKNSRQVEVSWEYPDTWSTPHSYFSLTFCVQVQGKSKREKKDR VFTDKTSATVICRKNASISVRAQDRYYSSSWSEWASVPCSGGGGSGGGGS GGGGSRNLPVATPDPGMFPCLHHSQNLLRAVSNMLQKARQTLEFYPCTS EEIDHEDITKDKTSTVEACLPLELTKNESCLNSRETSFITNGSCLASRKTSF MMALCLSSIYEDLKMYQVEFKTMNAKLLMDPKRQIFLDQNMLAVIDEL MQALNFNSETVPQKSSLEEPDFYKTKIKLCILLHAFRIRAVTIDRVMSYLN ASGSGSGSGSADFPTPSISDFEIPTSNIRRIICSTSGGFPEPHLSWLENGEELN AINTTVSQDPETELYAVSSKLDFNMTTNHSFMCLIKYGHLRVNQTFNWN TTKQEHFPDNLLPSWAITLISVNGIFVICCLTYCFAPRCERRGS* | 6088 | 6089 |
| OT-002096 (Met; CD8a Leader; CD19 scFV; CD8a Hinge and Transmembrane Domain; 4-1BB intracellular signaling domain; | MALPVTALLLPLALLLHAARPDIQMTQTTSSLSASLGDRVTISCRASQDIS KYLNWYQQKPDGTVKLLIYHTSRLHSGVPSRFSGSGSGTDYSLTISNLEQ EDIATYFCQQGNTLPYTFGGGTKLEITGGGGSGGGGSGGGGSEVKLQESG PGLVAPSQSLSVTCTVSGVSLPDYGVSWIRQPPRKGLEWLGVIWGSETTY YNSALKSRLTIIKDNSKSQVFLKMNSLQTDDTAIYYCAKHYYYGGSYAM DYWGQGTSVTVSSTTTPAPRPPTPAPTIASQPLSLRPEACRPAAGGAVHTR GLDFACDIYIWAPLAGTCGVLLLSLVITLYCKRGRKKLLYIFKQPFMRPV | 6090 | 6091 |

TABLE 9-continued

CA2 mbIL2 with CAR constructs

| ID | AA Sequence | AA SEQ ID NO. | NA SEQ ID NO. |
|---|---|---|---|
| CD3 zeta signaling domain; Linker (GS); P2A cleavage site; Met; Interleukin-12 subunit beta (p40) Leader; IL12B (p40) (23-328 of WT); Linker ((G4S)3); IL12A (p35) (57-253 of WT); Linker (GSGSGSGS); IgG1 Fc; B7-1 Hinge; B7-1 Transmembrane domain; B7-1 Tail; Linker (GS); stop) | QTTQEEDGCSCRFPEEEEGGCELRVKFSRSADAPAYKQGQNQLYNELNL GRREEYDVLDKRRGRDPEMGGKPRRKNPQEGLYNELQKDKMAEAYSEI GMKGERRRGKGHDGLYQGLSTATKDTYDALHMQALPPRGSATNFSLLK QAGDVEENPGPMCHQQLVISWFSLVFLASPLVAIWELKKDVYVVELDW YPDAPGEMVVLTCDTPEEDGITWTLDQSSEVLGSGKTLTIQVKEFGDAGQ YTCHKGGEVLSHSLLLLHKKEDGIWSTDILKDQKEPKNKTFLRCEAKNYS GRFTCWWLTTISTDLTFSVKSSRGSSDPQGVTCGAATLSAERVRGDNKEY EYSVECQEDSACPAAEESLPIEVMVDAVHKLKYENYTSSFFIRDIIKPDPPK NLQLKPLKNSRQVEVSWEYPDTWSTPHSYFSLTFCVQVQGKSKREKKDR VFTDKTSATVICRKNASISVRAQDRYYSSSWSEWASVPCSGGGGSGGGGS GGGGSRNLPVATPDPGMFPCLHHSQNLLRAVSNMLQKARQTLEFYPCTS EEIDHEDITKDKTSTVEACLPLELTKNESCLNSRETSFITNGSCLASRKTSF MMALCLSSIYEDLKMYQVEFKTMNAKLLMDPKRQIFLDQNMLAVIDEL MQALNFNSETVPQKSSLEEPDFYKTKIKLCILLHAFRIRAVTIDRVMSYLN ASGSGSGSGSDKTHTCPPCPAPELLGGPSVFLFPPKPKDTLMISRTPEVTCV VVDVSHEDPEVKFNWYVDGVEVHNAKTKPREEQYNSTYRVVSVLTVLH QDWLNGKEYKCKVSNKALPAPIEKTISKAKGQPREPQVYTLPPSRDELTK NQVSLTCLVKGFYPSDIAVEWESNGQPENNYKTTPPVLDSDGSFFLYSKL TVDKSRWQQGNVFSCSVMHEALHNHYTQKSLSLSPGKKQEHFPDNLLPS WAITLISVNGIFVICCLTYCFAPRCRERRGS* | | |

In some embodiments, the effector modules described herein may include one or more cleavage sites between the DD and mbIL12. Inclusion of cleavage sites may uncouple the proteolytic turnover of the DD from the payload, thereby altering the levels of expression of the payload independent of the DD. In some embodiments, the addition of the cleavage site my increase expression of the payload. In other aspects, addition of cleavage site may reduce the expression of the payload.

In some embodiments, the effector modules described herein may include payloads where regions of the payloads have been substituted for a sequence comprising G and S. As a non-limiting example, in regards to the amino acid sequence, the region may be 2, 3, 4, 5, 6, 7, 8, 9, 10, 11, 12, 13, 14, 15 or more than 15 amino acids in length. The amino acids of the payload may be replaced with a repeating pattern of GG, GS, SG, SS, GGG, GGS, GSS, GSG, SGG, SGS, SSG, SSS or a combination thereof.

In some embodiments, the effector modules described herein may include payloads where regions of the payloads have been substituted for a sequence comprising G and S. As a non-limiting example, in regards to the amino acid sequence, the region may be 6 amino acids in length. The amino acids of the payload may be replaced with GGS repeated once.

II. Pharmaceutical Compositions and Formulations

The present teachings further comprise pharmaceutical compositions comprising one or more of the stimuli, CA2 biocircuits, CA2 effector modules or systems of the present disclosure, and optionally at least one pharmaceutically acceptable excipient or inert ingredient.

As used herein the term "pharmaceutical composition" refers to a preparation of one or more of the CA2 biocircuits or components described herein, or pharmaceutically acceptable salts thereof, optionally with other chemical components such as physiologically suitable carriers and excipients.

The term "excipient" or "inactive ingredient" refers to an inert or inactive substance added to a pharmaceutical com-position to further facilitate administration of a compound. Non-limiting examples of such inert ingredients are disclosed herein under Formulations.

In some embodiments, compositions are administered to humans, human patients or subjects. For the purposes of the present disclosure, the phrase "active ingredient" generally refers to any one or more CA2 biocircuit system component to be delivered as described herein.

Although the descriptions of pharmaceutical compositions provided herein are principally directed to pharmaceutical compositions which are suitable for administration to humans, it will be understood by the skilled artisan that such compositions are generally suitable for administration to any other animal, e.g., to non-human animals, e.g. non-human mammals. Subjects to which administration of the pharmaceutical compositions is contemplated include, but are not limited to, non-human mammals, including agricultural animals such as cattle, horses, chickens and pigs, domestic animals such as cats, dogs, or research animals such as mice, rats, rabbits, dogs and non-human primates.

A pharmaceutical composition in accordance with the present disclosure may be prepared, packaged, and/or sold in bulk, as a single unit dose, and/or as a plurality of single unit doses. As used herein, a "unit dose" is discrete amount of the pharmaceutical composition comprising a predetermined amount of the active ingredient. The amount of the active ingredient is generally equal to the dosage of the active ingredient which would be administered to a subject and/or a convenient fraction of such a dosage such as, for example, one-half or one-third of such a dosage.

Relative amounts of the active ingredient, the pharmaceutically acceptable excipient or inert ingredient, and/or any additional ingredients in a pharmaceutical composition in accordance with the disclosure will vary, depending upon the identity, size, and/or condition of the subject treated and further depending upon the route by which the composition is to be administered. By way of example, the composition may comprise between 0.1% and 100%, e.g., between 0.5 and 50%, between 1-30%, between 5-80%, at least 80% (w/w) active ingredient.

Efficacy of treatment or amelioration of disease can be assessed, for example by measuring disease progression, disease remission, symptom severity, reduction in pain, quality of life, dose of a medication required to sustain a treatment effect, level of a disease marker or any other measurable parameter appropriate for a given disease being treated or targeted for prevention. It is well within the ability of one skilled in the art to monitor efficacy of treatment or prevention by measuring any one of such parameters, or any combination of parameters. In connection with the administration of compositions of the present disclosure, "effective against" for example a cancer, indicates that administration in a clinically appropriate manner results in a beneficial effect for at least a statistically significant fraction of patients, such as an improvement of symptoms, a cure, a reduction in disease load, reduction in tumor mass or cell numbers, extension of life, improvement in quality of life, or other effect generally recognized as positive by medical doctors familiar with treating the particular type of cancer.

A treatment or preventive effect is evident when there is a statistically significant improvement in one or more parameters of disease status, or by a failure to worsen or to develop symptoms where they would otherwise be anticipated. As an example, a favorable change of at least 10% in a measurable parameter of disease, and preferably at least 20%, 30%, 40%, 50% or more can be indicative of effective treatment. Efficacy for a given composition or formulation of the present disclosure can also be judged using an experimental animal model for the given disease as known in the art. When using an experimental animal model, efficacy of treatment is evidenced when a statistically significant change is observed.

Formulations

The compositions of the present disclosure may be formulated in any manner suitable for delivery. The formulation may be, but is not limited to, nanoparticles, poly (lactic-co-glycolic acid) (PLGA) microspheres, lipidoids, lipoplex, liposome, polymers, carbohydrates (including simple sugars), cationic lipids and combinations thereof.

In one embodiment, the formulation is a nanoparticle which may comprise at least one lipid. The lipid may be selected from, but is not limited to, DLin-DMA, DLin-K-DMA, 98N12-5, C12-200, DLin-MC3-DMA, DLin-KC2-DMA, DODMA, PLGA, PEG, PEG-DMG and PEGylated lipids. In another aspect, the lipid may be a cationic lipid such as, but not limited to, DLin-DMA, DLin-D-DMA, DLin-MC3-DMA, DLin-KC2-DMA and DODMA.

For polynucleotides described herein, the formulation may be selected from any of those taught, for example, in International Application PCT/US2012/06%10, the contents of which are incorporated herein by reference in its entirety.

Inactive Ingredients

In some embodiments, pharmaceutical or other formulations may comprise at least one excipient which is an inactive ingredient. As used herein, the term "inactive ingredient" refers to one or more inactive agents included in formulations. In some embodiments, all, none or some of the inactive ingredients which may be used in the formulations of the present disclosure may be approved by the US Food and Drug Administration (FDA).

III. Dosing Delivery and Administrations

The compositions described herein may be delivered to a cell or a subject through one or more routes and modalities. The viral vectors containing one or more CA2 effector modules, SREs, payloads and other components described herein may be used to deliver them to a cell and/or a subject. Other modalities may also be used such as mRNAs, plasmids, and as recombinant proteins.

Delivery

Naked Delivery

Pharmaceutical compositions, CA2 biocircuits, CA2 biocircuit components, CA2 effector modules including their SREs or payloads of the present disclosure may be delivered to cells, tissues, organs and/or organisms in naked form. As used herein, the term "naked" refers to pharmaceutical compositions, CA2 biocircuits, CA2 biocircuit components, CA2 effector modules including their SREs or payloads delivered free from agents or modifications which promote transfection or permeability. The naked pharmaceutical compositions, CA2 biocircuits, CA2 biocircuit components, CA2 effector modules including their SREs or payloads may be delivered to the cells, tissues, organs and/or organisms using routes of administration known in the art and described herein. In some embodiments, naked delivery may include formulation in a simple buffer such as saline or PBS.

Formulated Delivery

In some embodiments, pharmaceutical compositions, CA2 biocircuits, CA2 biocircuit components, CA2 effector modules including their SREs or payloads of the present disclosure may be formulated, using methods described herein. Formulations may comprise pharmaceutical compositions, CA2 biocircuits, CA2 biocircuit components, CA2 effector modules including their SREs or payloads which may be modified and/or unmodified. Formulations may further include, but are not limited to, cell penetration agents, pharmaceutically acceptable carriers, delivery agents, bioerodible or biocompatible polymers, solvents, and/or sustained-release delivery depots. Formulations of the present disclosure may be delivered to cells using routes of administration known in the art and described herein.

Pharmaceutical compositions, CA2 biocircuits, CA2 biocircuit components, CA2 effector modules including their SREs or payloads may also be formulated for direct delivery to organs or tissues in any of several ways in the art including, but not limited to, direct soaking or bathing, via a catheter, by gels, powder, ointments, creams, gels, lotions, and/or drops, by using substrates such as fabric or biodegradable materials coated or impregnated with compositions, and the like.

Delivery to Cells

In another aspect of the present disclosure, polynucleotides encoding CA2 biocircuits, CA2 effector modules, SREs (e.g., CA2 DDs), payloads of interest (e.g., immunotherapeutic agents) and compositions described herein and vectors comprising said polynucleotides may be introduced into cells. As a non-limiting example, the cells may be effector immune cells.

In some aspects of the present disclosure, polynucleotides encoding CA2 biocircuits, CA2 effector modules, SREs (e.g., CA2 DDs), payloads of interest (e.g., immunotherapeutic agents) and compositions of the disclosure, may be packaged into viral vectors or integrated into viral genomes allowing transient or stable expression of the polynucleotides. Preferable viral vectors are retroviral vectors including lentiviral vectors. In order to construct a retroviral vector, a polynucleotide molecule encoding a CA2 biocircuit, an CA2 effector module, a CA2 SRE (e.g., CA2 DD) or a payload of interest (e.g., an immunotherapeutic agent) is inserted into the viral genome in the place of certain viral sequences to produce a virus that is replication-defective. The recombinant viral vector is then introduced into a packaging cell line containing the gag, pol, and env genes, but without the LTR and packaging components. The recombinant retroviral particles are secreted into the culture media, then collected, optionally concentrated, and used for gene transfer. Lentiviral vectors are especially preferred as they are capable of infecting both dividing and non-dividing cells.

Vectors may also be transferred to cells by non-viral methods by physical methods such as needles, electroporation, sonoporation, hydroporation; chemical carriers such as inorganic particles (e.g. calcium phosphate, silica, gold) and/or chemical methods. In some embodiments, synthetic or natural biodegradable agents may be used for delivery such as cationic lipids, lipid nano emulsions, nanoparticles, peptide-based vectors, or polymer-based vectors.

In some embodiments, the polypeptides described herein may be delivered to the cell directly. In one embodiment, the polypeptides of the disclosure may be delivered using synthetic peptides comprising an endosomal leakage domain (ELD) fused to a cell penetration domain (CLD). The polypeptides of the present disclosure are co introduced into the cell with the ELD-CLD-synthetic peptide. ELDs facilitate the escape of proteins that are trapped in the endosome, into the cytosol. Such domains are derived proteins of microbial and viral origin and have been described in the art. CPDs allow the transport of proteins across the plasma membrane and have also been described in the art. The ELD-CLD fusion proteins synergistically increase the transduction efficiency when compared to the co-transduction with either domain alone. In some embodiments, a histidine rich domain may optionally be added to the shuttle construct as an additional method of allowing the escape of the cargo from the endosome into the cytosol. The shuttle may also include a cysteine residue at the N or C terminus to generate multimers of the fusion peptide. Multimers of the ELD-CLD fusion peptides generated by the addition of cysteine residue to the terminus of the peptide show even greater transduction efficiency when compared to the single fusion peptide constructs. The polypeptides of the invention may also be appended to appropriate localization signals to direct the cargo to the appropriate sub-cellular location e.g. nucleus. In some embodiments any of the ELDs, CLDs or the fusion ELD-CLD synthetic peptides taught in the International Patent Publication, WO2016161516 and WO2017175072 may be useful in the present invention (the contents of each of which are herein incorporated by reference in their entirety).

Delivery Modalities and/or Vectors

The CA2 biocircuit systems, CA2 effector modules, SREs and/or payloads of the present disclosure may be delivered using one or more modalities. The present disclosure also provides vectors that package polynucleotides described herein encoding CA2 biocircuits, CA2 effector modules, SREs (e.g., CA2 DDs) and payloads, and combinations thereof. Vectors of the present disclosure may also be used to deliver the packaged polynucleotides to a cell, a local tissue site or a subject. These vectors may be of any kind, including DNA vectors, RNA vectors, plasmids, viral vectors and particles. Viral vector technology is well known and described in Sambrook et al. (2001, Molecular Cloning: A Laboratory Manual, Cold Spring Harbor Laboratory, New York). Viruses, which are useful as vectors include, but are not limited to lentiviral vectors, adenoviral vectors, adeno-associated viral (AAV) vectors, herpes simplex viral vectors, retroviral vectors, oncolytic viruses, and the like.

In general, vectors contain an origin of replication functional in at least one organism, a promoter sequence and convenient restriction endonuclease site, and one or more selectable markers e.g. a drug resistance gene.

In some embodiments, the recombinant expression vector may comprise regulatory sequences, such as transcription and translation initiation and termination codons, which are specific to the type of host cell into which the vector is to be introduced.

In some embodiments, the vector described herein may comprise one or more payloads taught herein, wherein the two or more payloads may be included in one CA2 effector module. In this case, the two or more payloads are tuned by the same stimulus simultaneously. In other embodiments, the vector of the invention may comprise two or more CA2 effector modules, wherein each CA2 effector module comprises a different payload. In this case, the two or more CA2 effector modules and payloads are tuned by different stimuli, providing separately independent regulation of the two or more components.

Lentiviral Vehicles/Particles

In some embodiments, lentiviral vehicles/particles may be used as delivery modalities. Lentiviruses are a subgroup of the Retroviridae family of viruses, named because reverse transcription of viral RNA genomes to DNA is required before integration into the host genome. As such, the most important features of lentiviral vehicles/particles are the integration of their genetic material into the genome of a target/host cell. Some examples of lentivirus include the Human Immunodeficiency Viruses: HIV-1 and HIV-2, the Simian Immunodeficiency Virus (SIV), feline immunodeficiency virus (FIV), bovine immunodeficiency virus (BIV), Jembrana Disease Virus (JDV), equine infectious anemia virus (EIAV), equine infectious anemia virus, visna-maedi and caprine arthritis encephalitis virus (CAEV).

Typically, lentiviral particles making up the gene delivery vehicle are replication defective on their own (also referred to as "self-inactivating"). Lentiviruses are able to infect both dividing and non-dividing cells by virtue of the entry mechanism through the intact host nuclear envelope (Naldini L et al., Curr. Opin. Biotechnol, 1998, 9: 457-463). Recombinant lentiviral vehicles/particles have been generated by multiply attenuating the HIV virulence genes, for example, the genes Env, Vif, Vpr, Vpu, Nef and Tat are deleted making the vector biologically safe. Correspondingly, lentiviral vehicles, for example, derived from HIV-1/HIV-2 can mediate the efficient delivery, integration and long-term expression of transgenes into non-dividing cells. As used herein, the term "recombinant" refers to a vector or other nucleic acid containing both lentiviral sequences and non-lentiviral retroviral sequences.

Lentiviral particles may be generated by co-expressing the virus packaging elements and the vector genome itself in a producer cell such as human HEK293T cells. These elements are usually provided in three or four separate plasmids. The producer cells are co-transfected with plasmids that encode lentiviral components including the core (i.e. structural proteins) and enzymatic components of the virus, and the envelope protein(s) (referred to as the packaging systems), and a plasmid that encodes the genome including a foreign transgene, to be transferred to the target cell, the vehicle itself (also referred to as the transfer vector). In general, the plasmids or vectors are included in a producer cell line. The plasmids/vectors are introduced via transfection, transduction or infection into the producer cell line. Methods for transfection, transduction or infection are well known by those of skill in the art. As non-limiting example, the packaging and transfer constructs can be introduced into producer cell lines by calcium phosphate transfection, lipofection or electroporation, generally together with a dominant selectable marker, such as neo, DHFR, Gln synthetase or ADA, followed by selection in the presence of the appropriate drug and isolation of clones.

The producer cell produces recombinant viral particles that contain the foreign gene, for example, the CA2 effector module of the present disclosure. The recombinant viral particles are recovered from the culture media and titrated by standard methods used by those of skill in the art. The recombinant lentiviral vehicles can be used to infect target cells.

Cells that can be used to produce high-titer lentiviral particles may include, but are not limited to, HEK293T cells, 293G cells, STAR cells (Relander et al., *Mol. Ther.,* 2005, 11: 452459), FreeStyle™ 293 Expression System (ThermoFisher, Waltham, MA), and other HEK293T-based producer cell lines (e.g., Stewart et al., *Hum Gene Ther.* 2011, 22(3):357-369; Lee et al., *Biotechnol Bioeng,* 2012, 109%): 1551-1560; Throm et al., *Blood.* 2009, 113(21): 5104-5110; the contents of each of which are incorporated herein by reference in their entirety).

In some aspects, the envelope proteins may be heterologous envelope proteins from other viruses, such as the G protein of vesicular stomatitis virus (VSV G) or baculoviral gp64 envelop proteins. The VSV-G glycoprotein may especially be chosen among species classified in the vesiculovirus genus: *Carajas* virus (CJSV), Chandipura virus (CHPV), Cocal virus (COCV), Isfahan virus (ISFV), Maraba virus (MARAV), Piry virus (PIRYV), Vesicular stomatitis Alagoas virus (VSAV), Vesicular stomatitis Indiana virus (VSIV) and Vesicular stomatitis New Jersey virus (VSNJV) and/or stains provisionally classified in the vesiculovirus genus as Grass carp rhabdovirus, BeAn 157575 virus (BeAn 157575), Boteke virus (BTKV), Calchaqui virus (CQIV), Eel virus American (EVA), Gray Lodge virus (GLOV), Jurona virus (JURY), Klamath virus (KLAV), Kwatta virus (KWAV), La Joya virus (LJV), Malpais Spring virus (MSPV), Mount Elgon bat virus (MEBV), Perinet virus (PERV), Pikefry rhabdovirus (PFRV), Porton virus (PORV), Radi virus (RADIV), Spring viremia of carp virus (SVCV), *Tupaia* virus (TUPV), Ulcerative disease rhabdovirus (UDRV) and Yug Bogdanovac virus (YBV). The gp64 or other baculoviral env protein can be derived from *Autographa californica* nucleopolyhedrovirus (AcMNPV), *Anagrapha falcifera* nuclear polyhedrosis virus, *Bombyx mori* nuclear polyhedrosis virus, *Choristoneura fumiferana* nucleopolyhedrovirus, *Orgyia pseudotsugata* single capsid nuclear polyhedrosis virus, *Epiphyas postvittana* nucleopolyhedrovirus, *Hyphantria cunea* nucleopolyhedrovirus, *Galleria mellonella* nuclear polyhedrosis virus, Dhori virus, Thogoto virus, *Antheraea pemyi* nucleopolyhedrovirus or Batken virus.

Other elements provided in lentiviral particles may comprise retroviral LTR (long-terminal repeat) at either 5' or 3' terminus, a retroviral export element, optionally a lentiviral reverse response element (RRE), a promoter or active portion thereof, and a locus control region (LCR) or active portion thereof. The CA2 effector module is linked to the vector.

Methods for generating recombinant lentiviral particles are discussed in the art, for example, U.S. Pat. Nos. 8,846, 385; 7,745,179; 7,629,153; 7,575,924; 7,179,903; and 6,808,905; the contents of each of which are incorporated herein by reference in their entirety.

Lentivirus vectors used may be selected from, but are not limited to pLVX, pLenti, pLenti6, pLJM1, FUGW, pWPXL, pWPI, pLenti CMV puro DEST, pLJM1-EGFP, pULTRA, pInducer20, pHIV-EGFP, pCW57.1, pTRPE, pELPS, pRRL, and pLionII.

Lentiviral Vectors and Cell Engineering

Lentiviral vectors are used for introducing transgenes into T cells (e.g., primary human T cells or Jurkat cells) for preclinical research and clinical applications, including recently approved products such as Tisagenlecleucel (KYMRIAH®) for relapsed/refractory B-cell lymphoma. VSV-G pseudotyped 3rd generation lentiviral vectors offer high titers, high transduction efficiency and safety, and have become the vectors of choice for T cell engineering. While not wishing to be bound by theory, T cell engineering usually involves T cell activation by CD3/CD28 antibodies, followed by lentivirus transduction, and then cell expansion which can last from 5 to 30 days (e.g., 9 to 14 days or 9 to 15 days). In general, lentivirus transgene integration may take over 7 days to fully stabilize in T cells (e.g., primary human T cells or Jurkat cells). While longer cultures can increase the cell numbers, the longer cultures can also change the T cell phenotype to a more differentiated state. Therefore, the duration of ex vivo culture can impact the persistence and efficacy of CAR T cells. For example, cells cultured for shorter duration may display a less differentiated phenotype and can be highly efficacious in preclinical models.

While not wishing to be bound by theory, the state of T cell differentiation may influence the engraftment and persistence of T cells following adoptive transfer. Ghassemi et al (Reducing Ex Vim Culture Improves the Antileukemic Activity of Chimeric Antigen Receptor (CAR) T Cells. Cancer Immunol Res; 6(9) September 2018; the contents of which are herein incorporated by reference in their entirety) describe primary human T cell differentiation over time and saw that early harvested CAR T cells exhibited enhanced effector function and proliferation, as well as enhanced potency and persistence in vivo.

Lentivirus dynamics such as transduction, integration and/or expression kinetics of lentivirally introduced transgenes in T cells (e.g., primary human T cells or Jurkat cells) ex vivo may impact the efficacy and durability of in vivo anti-tumor responses. Some types of T cells may produce different results. For example, the Jurkat cell line may not provide the dynamic range of expression as primary human T cells. Methods to evaluate these lentivirus dynamics are known in the art and are described herein.

In some embodiments, to determine the transgene expression kinetics CD3/CD28 activated primary human T cells can be transduced with lentivirus carrying a transgene (e.g., a regulated transgene or constitutive transgene such as CD19 CAR, IL12, fluorescent protein or any transgene (e.g., payload) described herein). The cells may be analyzed by methods described herein and/or known in the art for viability, viral genomic integration (e.g., by using quantitative PCR), transcript levels (e.g., by using quantitative RT-PCR), and cell surface expression of the transgene if applicable (e.g., if the transgene is or includes CD19 CAR then the surface expression of the CD19 CAR can be evaluated). The cells may be analyzed prior to transduction and/or after transduction such as 1 day, 2 days, 3 days, 4 days, 5 days, 6 days, 7 days, 8 days, 9 days, 10 days, 11 days, 12 days, 13 days, 14 days, 15 days, 16 days, 17 days, 18 days, 19 days, 20 days, 21 days, 22 days, 23 days, 24 days, 25 days, 26 days, 27 days, 28 days, 29 days, 30 or more than 30 days after transduction.

In some embodiments, the CD3/CD28 activated primary human T cells can be reactivated with CD3/CD28 beads after transduction. The cells may be reactivated 5 days, 6 days, 7 days, 8 days, 9 days, 10 days, 11 days, 12 days, 13 days, 14 days, 15 days, 16 days, 17 days, 18 days, 19 days, 20 days, 21 days, 22 days, 23 days, 24 days, 25 days, 26 days, 27 days, 28 days, 29 days, 30 or more than 30 days after transduction. The cells may be analyzed by methods described herein and/or known in the art for viability, viral genomic integration (e.g., by using quantitative PCR), transcript levels (e.g., by using quantitative RT-PCR), cell surface expression of the transgene if applicable (e.g., if the transgene is or includes CD19 CAR then the surface expression of the CD19 CAR can be evaluated), copy number, and/or mRNA levels.

In some embodiments, the cell viability of activated primary human T cells transduced with lentivirus carrying a transgene is greater than 65%, 70%, 75%, 80%, 85%, 90%, 95%, 97%, or 99%. As a non-limiting example, the cell viability is greater than 90%. As a non-limiting example, the cell viability is greater than 85%.

In some embodiments, the cell viability of Jurkat cells transduced with lentivirus carrying a transgene is greater than 65%, 70%, 75%, 80%, 85%, 90%, 95%, 97%, or 99%. As a non-limiting example, the cell viability is greater than 90%. As a non-limiting example, the cell viability is greater than 85%.

In some embodiments, the integration of the transgene into the genome of the cell may be at or above the saturation point. As a non-limiting example, the saturation point may be 3 copies per cell.

In some embodiments, the integration of the transgene into the genome may be high in the initial timepoints evaluated and then decline to a lower integration value before becoming stable for the remainder of the culture. As a non-limiting example, the integration may be up to 20 copies per cell of the transgene into the genome during the early timepoints before declining to 2 copies per cell and being stable throughout the remainder of the culture.

In some embodiments, the transduction ability of T cells may be evaluated. T cells from at least one donor may be transduced with a lentivirus containing a transgene at a dose that is predicted to reach the saturating levels (e.g., enough virus that each cell should contain a copy if a Poisson distribution is expected) and a higher lentivirus dose that exceeds saturation 5 times. Copies per cell, percentage and MFI of cells (or concentration in media of transgene) may be detected in order to determine if all cells are expressing transgene. As a non-limiting example, T cells from two distinct donors may be transduced with lentivirus which includes a transgene. The transduction may be at two doses, saturation and 5× saturation, and show that 5-10 days after transduction that all groups may reach or exceed a predicted saturating level of integrated transgene and similar expression intensity across groups but not all cells are expressing the transgene. Not all T cells may have equal transduction susceptibility, even when sourced from the same donor. The fraction of total cells that express GFP (above the detection threshold) may vary between donors, lots and/or viral dose. The percent of total cells that express GFP from a single donor may be between 70% and 95%.

In some embodiments, a percentage of the cultured T cells (e.g., primary human T cells and/or Jurkat cells) may express the transgene. The percentage of cultured T cells expressing the transgene may be, but is not limited to, 5%, 10%, 15%, 20%, 25%, 30%, 35%, 40%, 45%, 50%, 55%, 60%, 65%, 70%, 75%, 80%, 85%, 90%, 95%, 97%, 99% or greater than 99%. As a non-limiting example, the percentage may be greater than 70%. As a non-limiting example, the percentage may be greater than 75%. As a non-limiting example, the percentage may be greater than 80%. As a non-limiting example, the percentage may be greater than 85%. As a non-limiting example, the percentage may be greater than 90%. As a non-limiting example, the percentage may be greater than 95%.

In some embodiments, the mRNA levels from the culture may decline over the duration of the study. The decline may not be limited to a specific transgene and the trend may be seen across multiple classes of expressed proteins. In order to increase the mRNA levels, the cells may be reactivated after the mRNA levels decrease from the initial levels. The cells may be reactivated 5 days, 6 days, 7 days, 8 days, 9 days, 10 days, 11 days, 12 days, 13 days, 14 days, 15 days, 16 days, 17 days, 18 days, 19 days, 20 days, 21 days, 22 days, 23 days, 24 days, 25 days, 26 days, 27 days, 28 days, 29 days, 30 or more than 30 days after transduction. As a non-limiting example, in order to increase mRNA levels in the culture, the cells may be reactivated with CD3/CD28 beads 13 days after transduction.

In some embodiments, the surface expression from the culture may decline over the duration of the study. For example, the surface expression may decline between days 3 to 13 days, 3 to 14 days, or 3 to 15 days after transduction. In order to increase the surface expression, the cells may be reactivated after the surface expression decrease from the initial levels. The cells may be reactivated 5 days, 6 days, 7 days, 8 days, 9 days, 10 days, 11 days, 12 days, 13 days, 14 days, 15 days, 16 days, 17 days, 18 days, 19 days, 20 days, 21 days, 22 days, 23 days, 24 days, 25 days, 26 days, 27 days, 28 days, 29 days, 30 or more than 30 days after transduction.

In some embodiments, the transgene is a CAR such as, but not limited to, CD19 CAR. As a non-limiting example, the CAR is CD19 CAR. The cell viability may be greater than 90% in cells transduced with a CD19 CAR. The cell viability may be greater than 85% in cells transduced with a CD19 CAR. If the cells are primary T cells transduced with a CD19 CAR, then number of viable cells may increase over the initial timepoints before decreasing. If the cells are Jurkat cells transduced with a CD19 CAR, then the number of viable cells may increase for at least 10 days. The number of copies per cell for CD19 CAR transduced cells may be higher for the initial timepoints before decreasing by 50% or more for the later timepoints. The cell surface expression of CD19 CAR may decrease during the course of the study from about 20000 CAR MFI to less than 5000 CAR MFI over a period of 10 days (e.g., day 3 to day 13). After restimulation on day 15 the MFI may increase to above 5000 CAR MFI. The percentage of primary human T cells expressing CAR may be between 40% and 60% for 3-13 days after transduction. The percentage of Jurkat cells expressing CAR may be between 30% and 70% for 3-13 days after transduction. An initial decline of about 20% may be seen between days 3 and 6 after transduction. Restimulation of the T cells may increase the percent of CAR positive cells back to initial percentage levels (e.g., around 60%).

In some embodiments, the transgene encodes a fluorescent protein such as, but not limited to cytosolic green fluorescence protein (GFP), luciferase, and mCherry. As a non-limiting example, the fluorescent protein is GFP. The cell viability may be greater than 90% in cells transduced with GFP. The cell viability may be greater than 85% in cells transduced with GFP. If the cells are primary T cells transduced with GFP, then the number of viable cells may increase over the initial timepoints before decreasing. If the cells are Jurkat cells transduced with GFP, then the number of viable cells may increase for at least 10 days. The number of copies per cell for GFP transduced cells may be higher for the initial timepoints before decreasing by 50% or more for the later timepoints. The surface expression of the cells may have a steady and rapid decline bottoming out at day 10 with a slight increase if restimulated. The highest level of cell surface expression of GFP in Jurkat cells may be at day 10 (about 35000 GFP MFI) before decreasing for the rest of the study. The percentage of primary human T cells expressing GFP may be around 80% for 3-13 days after transduction. The percentage of Jurkat cells expressing GFP may be around 90% for 3-13 days after transduction.

In some embodiments, lentivirally engineered cells described herein have genomic DNA integration that stabilizes after an initial decline of copy number, decreasing RNA and surface expression levels over time, and an increase in RNA and surface expression after re-stimulation.

In some embodiments, lentivirally engineering cells may be evaluated using the following 14-day method where samples are collected 5 times throughout the culture. On day −1 the T cells (e.g., primary human T cells or Jurkat cells) may be thawed and the CD3/CD28 beads are added. On day 0, the lentivirus for each of the conditions is added (e.g., 4 mL of cells at 0.5e6/mL) and there is a control of non-transduced cells. Double media to 8 mL on day 1 and then double the media to 16 mL on day 2. On day 3, harvest 4 mL and then double media to 24 mL on day 4. Harvest 4 mL on day 6 before doubling media to 40 mL. The cells can be split (e.g., 14 mL 0.5e6 cells/mL) on day 8 and then on day 6 harvest 4 mL before doubling media to 40 mL. 4 mL may be harvested on day 10 before the media is doubled to 20 mL. On day 13, 4 mL are harvested before doubling the media to 32 mL. The culture is split in half and half of the culture is activated (CD3/CD28 activation beads 1:1) and stimulated overnight. On day 14, 4 mL of each stimulated and non-stimulated cells are harvested and the culture is ended. Transgene copy number per cell are assayed by harvesting cells and extracting genomic DNA then quantifying with standard curve qPCR against the endogenous genome and against the transgene sequence, then converting the detected quantities to a ratio. Mean Fluorescence Intensity (MFI) is assayed by flow cytometry with appropriate staining for each group. Percent expressing may also be assayed by flow cytometry quantifying the percent of cells fluorescing above threshold. Soluble payloads can be quantified by harvesting culture supernatant at each marked timepoint and running MesoScale Discovery plate assay (MSD) then normalizing for cell density.

Adeno-Associated Viral Particles

Delivery of any of the CA2 biocircuits, CA2 biocircuit components, CA2 effector modules, SREs or payloads of the present disclosure may be achieved using recombinant adeno-associated viral (rAAV) vectors. Such vectors or viral particles may be designed to utilize any of the known serotype capsids or combinations of serotype capsids.

AAV vectors include not only single stranded vectors but self-complementary AAV vectors (scAAVs). scAAV vectors contain DNA which anneals together to form double stranded vector genome. By skipping second strand synthesis, scAAVs allow for rapid expression in the cell.

The rAAV vectors may be manufactured by standard methods in the art such as by triple transfection, in sf9 insect cells or in suspension cell cultures of human cells such as HEK293 cells.

The CA2 biocircuits, CA2 biocircuit components, CA2 effector modules, SREs or payloads may be encoded in one or more viral genomes to be packaged in the AAV capsids taught herein.

Such vector or viral genomes may also include, in addition to at least one or two ITRs (inverted terminal repeats), certain regulatory elements necessary for expression from the vector or viral genome. Such regulatory elements are well known in the art and include for example promoters, introns, spacers, stuffer sequences, and the like.

The CA2 biocircuits, CA2 biocircuit components, CA2 effector modules, SREs or payloads described herein may be administered in one or more AAV particles.

In some embodiments, the CA2 effector modules may be administered in one or more AAV particles. In some embodiments, more than one CA2 effector module or SRE may be encoded in a viral genome.

Retroviral Vehicles/Particles (γ-Retroviral Vectors)

In some embodiments, retroviral vehicles/particles may be used to deliver the CA2 biocircuits, CA2 biocircuit components, CA2 effector modules, SREs or payloads of the present disclosure. Retroviral vectors (RVs) allow the permanent integration of a transgene in target cells. In addition to lentiviral vectors based on complex HIV-1/2, retroviral vectors based on simple gamma-retroviruses have been widely used to deliver therapeutic genes and demonstrated clinically as one of the most efficient and powerful gene delivery systems capable of transducing a broad range of cell types. Example species of Gamma retroviruses include the murine leukemia viruses (MLVs) and the feline leukemia viruses (FeLV).

In some embodiments, gamma-retroviral vectors derived from a mammalian gamma-retrovirus such as murine leukemia viruses (MLVs), are recombinant. The MLV families of gamma retroviruses include the ecotropic, amphotropic, xenotropic and polytropic subfamilies. Ecotropic viruses are able to infect only murine cells using mCAT-1 receptor. Examples of ecotropic viruses are Moloney MLV and AKV. Amphotropic viruses infect murine, human and other species through the Pit-2 receptor. One example of an amphotropic virus is the 4070A virus. Xenotropic and polytropic viruses utilize the same (Xpr1) receptor but differ in their species tropism. Xenotropic viruses such as NZB-9-1 infect human and other species but not murine species, whereas polytropic viruses such as focus-forming viruses (MCF) infect murine, human and other species.

Gamma-retroviral vectors may be produced in packaging cells by co-transfecting the cells with several plasmids including one encoding the retroviral structural and enzymatic (gag-pol) polyprotein, one encoding the envelope (env) protein, and one encoding the vector mRNA comprising polynucleotide encoding the compositions of the present disclosure that is to be packaged in newly formed viral particles.

In some aspects, the recombinant gamma-retroviral vectors are pseudotyped with envelope proteins from other viruses. Envelope glycoproteins are incorporated in the outer lipid layer of the viral particles which can increase/alter the cell tropism. Exemplary envelop proteins include the gibbon ape leukemia virus envelope protein (GALV) or vesicular stomatitis virus G protein (VSV-G), or Simian endogenous retrovirus envelop protein, or Measles Virus H and F proteins, or Human immunodeficiency virus gp120 envelop protein, or cocal vesiculovirus envelop protein (See, e.g., U.S. application publication NO.: 2012/164118; the contents of which are incorporated herein by reference in its entirety). In other aspects, envelope glycoproteins may be genetically modified to incorporate targeting/binding ligands into gamma-retroviral vectors, binding ligands including, but not limited to, peptide ligands, single chain antibodies and growth factors (Waehler et al., *Nat. Rev. Genet.* 2007, 8(8):573-587; the contents of which are incorporated herein by reference in its entirety). These engineered glycoproteins can retarget vectors to cells expressing their corresponding target moieties. In other aspects, a "molecular bridge" may be introduced to direct vectors to specific cells. The molecular bridge has dual specificities: one end can recognize viral glycoproteins, and the other end can bind to the molecular determinant on the target cell. Such molecular bridges, for example ligand-receptor, avidin-biotin, and chemical conjugations, monoclonal antibodies and engineered fusogenic proteins, can direct the attachment of viral vectors to target cells for transduction (Yang et al., *Biotechnol. Bioeng.*, 2008, 101(2): 357-368; and Maetzig et al., *Viruses,* 2011, 3, 677-713; the contents of each of which are incorporated herein by reference in their entirety).

In some embodiments, the recombinant gamma-retroviral vectors are self-inactivating (SIN) gammaretroviral vectors. The vectors are replication incompetent. SIN vectors may harbor a deletion within the 3' U3 region initially comprising enhancer/promoter activity. Furthermore, the 5' U3 region may be replaced with strong promoters (needed in the packaging cell line) derived from Cytomegalovirus or RSV, or an internal promotor of choice, and/or an enhancer element. The choice of the internal promotors may be made according to specific requirements of gene expression needed for a particular purpose of the present disclosure.

In some embodiments, polynucleotides encoding the CA2 biocircuit, CA2 biocircuit components, CA2 effector module, SRE are inserted within the recombinant viral genome. The other components of the viral mRNA of a recombinant gamma-retroviral vector may be modified by insertion or removal of naturally occurring sequences (e.g., insertion of an IRES, insertion of a heterologous polynucleotide encoding a polypeptide or inhibitory nucleic acid of interest, shuffling of a more effective promoter from a different retrovirus or virus in place of the wild-type promoter and the like). In some examples, the recombinant gamma-retroviral vectors may comprise modified packaging signal, and/or primer binding site (PBS), and/or 5'-enhancer/promoter elements in the U3-region of the 5'-long terminal repeat (LTR), and/or 3'-SIN elements modified in the U3-region of the 3'-LTR. These modifications may increase the titers and the ability of infection.

Gammaretroviral vectors suitable for delivering CA2 biocircuit components, CA2 effector modules, SREs or payloads of the present disclosure may be selected from those disclosed in U.S. Pat. Nos. 8,828,718; 7,585,676; 7,351,585; U.S. application publication NO.: 2007/048285; PCT application publication NOs.: WO2010/113037; WO2014/121005; WO2015/056014; and EP Pat. NOs.: EP1757702; EP1757703 (the contents of each of which are incorporated herein by reference in their entirety).

Oncolytic Viral Vector

In some embodiments, polynucleotides of present disclosure may be packaged into oncolytic viruses. As used herein, the term "oncolytic virus" refers to a virus that preferentially infects and kills cancer cells such as vaccine viruses. An oncolytic virus can occur naturally or can be a genetically modified virus such as oncolytic adenovirus, and oncolytic herpes virus.

In some embodiments, oncolytic vaccine viruses may include viral particles of a thymidine kinase (TK)-deficient, granulocyte macrophage (GM)-colony stimulating factor (CSF)-expressing, replication-competent vaccinia virus vector sufficient to induce oncolysis of cells in the tumor, See e.g., U.S. Pat. No. 9,226,977; the contents of which are incorporated herein by reference in their entirety.

Messenger RNA (mRNA)

In some embodiments, the CA2 effector modules described herein may be designed as a messenger RNA (mRNA). As used herein, the term "messenger RNA" (mRNA) refers to any polynucleotide which encodes a polypeptide of interest and which is capable of being translated to produce the encoded polypeptide of interest in vitro, in vivo, in situ or ex vivo. Such mRNA molecules may have the structural components or features of any of those taught in International Application number PCT/US2013/030062, the contents of which are incorporated herein by reference in its entirety.

In some embodiments, the CA2 effector modules may be designed as self-amplifying RNA. "Self-amplifying RNA" as used herein refers to RNA molecules that can replicate in the host resulting in the increase in the amount of the RNA and the protein encoded by the RNA. Such self-amplifying RNA may have structural features or components of any of those taught in International Patent Application Publication No. WO2011005799 (the contents of which are incorporated herein by reference in their entirety).

Dosing

The present disclosure provides methods comprising administering any one or more or component of a CA2 biocircuit system to a subject in need thereof. These may be administered to a subject using any amount and any route of administration effective for preventing or treating or imaging a disease, disorder, and/or condition (e.g., a disease, disorder, and/or condition relating to cancer or an autoimmune disease). The exact amount required will vary from subject to subject, depending on the species, age, and general condition of the subject, the severity of the disease, the particular composition, its mode of administration, its mode of activity, and the like.

Compositions in accordance with the present disclosure are typically formulated in dosage unit form for ease of administration and uniformity of dosage. It will be understood, however, that the total daily usage of the compositions of the present disclosure may be decided by the attending physician within the scope of sound medical judgment. The specific therapeutically effective, prophylactically effective, or appropriate imaging dose level for any particular patient will depend upon a variety of factors including the disorder being treated and the severity of the disorder, the activity of the specific compound employed; the specific composition employed; the age, body weight, general health, sex and diet of the patient; the time of administration, route of administration, and rate of excretion of the specific compound employed; the duration of the treatment; drugs used in combination or coincidental with the specific compound employed; and like factors well known in the medical arts.

In some embodiments, compositions described herein may be used in varying doses to avoid T cell exhaustion, prevent cytokine release syndrome and minimize toxicity associated with immunotherapy. For example, low doses of the compositions of the present disclosure may be used to initially treat patients with high tumor burden, while patients with low tumor burden may be treated with high and repeated doses of the compositions described herein to ensure recognition of a minimal tumor antigen load. In another instance, the compositions of the present invention may be delivered in a pulsatile fashion to reduce tonic T cell signaling and enhance persistence in vivo. In some aspects, toxicity may be minimized by initially using low doses of the compositions of the invention, prior to administering high doses. Dosing may be modified if serum markers such as ferritin, serum C-reactive protein, IL6, IFN-γ, and TNF-α are elevated.

In some embodiments, the neurotoxicity may be associated with CAR or TIL therapy. Such neurotoxicity may be associated CD19-CARs. Toxicity may be due to excessive T cell infiltration into the brain. In some embodiments, neurotoxicity may be alleviated by preventing the passage of T cells through the blood brain barrier. This can be achieved by the targeted gene deletion of the endogenous alpha-4 integrin inhibitors such as tysabri/natalizumab may also be useful in the present invention.

Also provided herein are methods of administering ligands in accordance with the invention to a subject in need thereof. The ligand may be administered to a subject or to cells, using any amount and any route of administration effective for tuning the CA2 biocircuits of the invention. The exact amount required will vary from subject to subject, depending on the species, age, and general condition of the subject, the severity of the disease, the particular composition, its mode of administration, its mode of activity, and the like. The subject may be a human, a mammal, or an animal. Compositions in accordance with the invention are typically formulated in unit dosage form for ease of administration and uniformity of dosage. It will be understood, however, that the total daily usage of the compositions of the present invention may be decided by the attending physician within the scope of sound medical judgment. In certain embodiments, the ligands in accordance with the present invention may be administered at dosage levels sufficient to deliver from about 0.0001 mg/kg to about 100 mg/kg, from about 0.001 mg/kg to about 0.05 mg/kg, from about 0.005 mg/kg to about 0.05 mg/kg, from about 0.001 mg/kg to about 0.005 mg/kg, from about 0.05 mg/kg to about 0.5 mg/kg, from about 0.01 mg/kg to about 50 mg/kg, from about 0.1 mg/kg to about 40 mg/kg, from about 0.5 mg/kg to about 30 mg/kg, from about 0.01 mg/kg to about 10 mg/kg, from about 0.1 mg/kg to about 10 mg/kg, or from about 1 mg/kg to about 25 mg/kg, from about 10 mg/kg to about 100 mg/kg, from about 50 mg/kg to about 500 mg/kg, from about 100 mg/kg to about 1000 mg/kg, of subject body weight per day, one or more times a day, to obtain the desired effect. In some embodiments, the dosage levels may be 1 mg/kg, 5 mg/kg, 10 mg/kg, 20 mg/kg, 30 mg/kg, 40 mg/kg, 50 mg/kg, 60 mg/kg, 70 mg/kg, 80 mg/kg, 90 mg/kg, 100 mg/kg, 100 mg/kg, 110 mg/kg, 120 mg/kg, 130 mg/kg, 140 mg/kg, 150 mg/kg, 160 mg/kg, 170 mg/kg, 180 mg/kg, 190 mg/kg or mg/kg of subject body weight per day, or more times a day, to obtain the desired effect.

The present disclosure provides methods for delivering to a cell or tissue any of the ligands described herein, comprising contacting the cell or tissue with said ligand and can be accomplished in vitro, ex vivo, or in vivo. In certain embodiments, the ligands in accordance with the present invention may be administered to cells at dosage levels sufficient to deliver from about 1 nM to about 10 nM, from about 5 nM to about 50 nM, from about 10 nM to about 100 nM, from about 50 nM to about 500 nM, from about 100 nM to about 1000 nM, from about 1 μM to about 10 μM, from about 5 μM to about 50 μM from about 10 μM to about 100 μM from about 25 μM to about 250 μM from about 50 μM to about 500 μM. In some embodiments, the ligand may be administered to cells at doses selected from but not limited to 0.00064 μM, 0.0032 μM, 0.016 μM, 0.08 μM, 0.4 μM, 1 μM, 2 μM, 10 μM, 50 μM, 75, μM, 100 μM, 150 μM, 175 μM 200 μM, 250 μM.

The desired dosage of the ligands of the present invention may be delivered only once, three times a day, two times a day, once a day, every other day, every third day, every week, every two weeks, every three weeks, or every four weeks. In certain embodiments, the desired dosage may be delivered using multiple administrations (e.g., two, three, four, five, six, seven, eight, nine, ten, eleven, twelve, thirteen, fourteen, or more administrations). When multiple administrations are employed, split dosing regimens such as those described herein may be used. As used herein, a "split dose" is the division of "single unit dose" or total daily dose into two or more doses, e.g., two or more administrations of the "single unit dose". As used herein, a "single unit dose" is a dose of any therapeutic administered in one dose/at one time/single route/single point of contact, i.e., single administration event. The desired dosage of the ligand of the present disclosure may be administered as a "pulse dose" or as a "continuous flow". As used herein, a "pulse dose" is a series of single unit doses of any therapeutic administered with a set frequency over a period of time. As used herein, a "continuous flow" is a dose of therapeutic administered continuously for a period of time in a single route/single point of contact, i.e., continuous administration event. A total daily dose, an amount given or prescribed in 24-hour period, may be administered by any of these methods, or as a combination of these methods, or by any other methods suitable for a pharmaceutical administration.

Administration

In some embodiments, the compositions for immunotherapy may be administered to cells ex vivo and subsequently administered to the subject. Immune cells can be isolated and expanded ex vivo using a variety of methods known in the art. For example, methods of isolating cytotoxic T cells are described in U.S. Pat. Nos. 6,805,861 and 6,531,451; the contents of each of which are incorporated herein by reference in their entirety. Isolation of NK cells is described in U.S. Pat. No. 7,435,596; the contents of which are incorporated by reference herein in its entirety.

In some embodiments, depending upon the nature of the cells, the cells may be introduced into a host organism e.g. a mammal, in a wide variety of ways including by injection, transfusion, infusion, local instillation or implantation. In some aspects, the cells described herein may be introduced at the site of the tumor. The number of cells that are employed will depend upon a number of circumstances, the purpose for the introduction, the lifetime of the cells, the protocol to be used, for example, the number of administrations, the ability of the cells to multiply, or the like. The cells may be in a physiologically-acceptable medium.

In some embodiments, the cells described herein may be administrated in multiple doses to subjects having a disease or condition. The administrations generally effect an improvement in one or more symptoms of cancer or a clinical condition and/or treat or prevent cancer or clinical condition or symptom thereof.

In some embodiments, the compositions for immunotherapy may be administered in vivo. In some embodiments, polypeptides of the present disclosure comprising CA2 biocircuits, CA2 effector molecules, SREs, payloads of interest (e.g., immunotherapeutic agents) and compositions described herein may be delivered in vivo to the subject. In vivo delivery of immunotherapeutic agents is well described in the art. For example, methods of delivery of cytokines are described in the E.P. Pat. No. EP0930892 A1, the contents of which are incorporated herein by reference.

Routes of Delivery

The pharmaceutical compositions, CA2 biocircuits, CA2 biocircuit components, CA2 effector modules including their SREs (e.g., CA2 DDs), payloads (e.g., immunotherapeutic agents), vectors and cells of the present disclosure may be administered by any route to achieve a therapeutically effective outcome.

These include, but are not limited to enteral (into the intestine), gastroenteral, epidural (into the dura matter), oral (by way of the mouth), transdermal, peridural, intracerebral (into the cerebrum), intracerebroventricular (into the cerebral ventricles), epicutaneous (application onto the skin), intradermal, (into the skin itself), subcutaneous (under the skin), nasal administration (through the nose), intravenous (into a vein), intravenous bolus, intravenous drip, intraarterial (into an artery), intramuscular (into a muscle), intracardiac (into the heart), intraosseous infusion (into the bone marrow), intrathecal (into the spinal canal), intraperitoneal, (infusion or injection into the peritoneum), intravesical infusion, intravitreal, (through the eye), intracavernous injection (into a pathologic cavity) intracavitary (into the base of the penis), intravaginal administration, intrauterine, extra-amniotic administration, transdermal (diffusion through the intact skin for systemic distribution), transmucosal (diffusion through a mucous membrane), transvaginal, insufflation (snorting), sublingual, sublabial, enema, eye drops (onto the conjunctiva), in ear drops, auricular (in or by way of the ear), buccal (directed toward the cheek), conjunctival, cutaneous, dental (to a tooth or teeth), electroosmosis, endocervical, endosinusial, endotracheal, extracorporeal, hemodialysis, infiltration, interstitial, intraabdominal, intra-amniotic, intra-articular, intrabiliary, intrabronchial, intrabursal, intracartilaginous (within a cartilage), intracaudal (within the cauda equine), intracisternal (within the cisterna magna cerebellomedularis), intracorneal (within the cornea), dental intracornal, intracoronary (within the coronary arteries), intracorporus cavernosum (within the dilatable spaces of the corporus cavernosa of the penis), intradiscal (within a disc), intraductal (within a duct of a gland), intraduodenal (within the duodenum), intradural (within or beneath the dura), intraepidermal (to the epidermis), intraesophageal (to the esophagus), intragastric (within the stomach), intragingival (within the gingivae), intraileal (within the distal portion of the small intestine), intralesional (within or introduced directly to a localized lesion), intraluminal (within a lumen of a tube), intralymphatic (within the lymph), intramedullary (within the marrow cavity of a bone), intrameningeal (within the meninges), intramyocardial (within the myocardium), intraocular (within the eye), intraovarian (within the ovary), intrapericardial (within the pericardium), intrapleural (within the pleura), intraprostatic (within the prostate gland), intrapulmonary (within the lungs or its bronchi), intrasinal (within the nasal or periorbital sinuses), intraspinal (within the vertebral column), intrasynovial (within the synovial cavity of a joint), intratendinous (within a tendon), intratesticular (within the testicle), intrathecal (within the cerebrospinal fluid at any level of the cerebrospinal axis), intrathoracic (within the thorax), intratubular (within the tubules of an organ), intratumor (within a tumor), intratympanic (within the aurus media), intravascular (within a vessel or vessels), intraventricular (within a ventricle), iontophoresis (by means of electric current where ions of soluble salts migrate into the tissues of the body), irrigation (to bathe or flush open wounds or body cavities), laryngeal (directly upon the larynx), nasogastric (through the nose and into the stomach), occlusive dressing technique (topical mute administration which is then covered by a dressing which occludes the area), ophthalmic (to the external eye), oropharyngeal (directly to the mouth and pharynx), parenteral, percutaneous, periarticular, peridural, perineural, periodontal, rectal, respiratory (within the respiratory tract by inhaling orally or nasally for local or systemic effect), retrobulbar (behind the pons or behind the eyeball), intramyocardial (entering the myocardium), soft tissue, subarachnoid, subconjunctival, submucosal, topical, transplacental (through or across the placenta), transtracheal (through the wall of the trachea), transtympanic (across or through the tympanic cavity), ureteral (to the ureter), urethral (to the urethra), vaginal, caudal block, diagnostic, nerve block, biliary perfusion, cardiac perfusion, photopheresis or spinal.

Parenteral and Injectable Administration

In some embodiments, pharmaceutical compositions, CA2 biocircuits, CA2 biocircuit components, CA2 effector modules including their SREs or payloads of the present disclosure may be administered parenterally. Liquid dosage forms for oral and parenteral administration include, but are not limited to, pharmaceutically acceptable emulsions, microemulsions, solutions, suspensions, syrups, and/or elixirs. In addition to active ingredients, liquid dosage forms may comprise inert diluents commonly used in the art such as, for example, water or other solvents, solubilizing agents and emulsifiers such as ethyl alcohol, isopropyl alcohol, ethyl carbonate, ethyl acetate, benzyl alcohol, benzyl benzoate, propylene glycol, 1,3-butylene glycol, dimethylformamide, oils (in particular, cottonseed, groundnut, corn, germ, olive, castor, and sesame oils), glycerol, tetrahydrofurfuryl alcohol, polyethylene glycols and fatty acid esters of sorbitan, and mixtures thereof. Besides inert diluents, oral compositions can include adjuvants such as wetting agents, emulsifying and suspending agents, sweetening, flavoring, and/or perfuming agents. In certain embodiments for parenteral administration, compositions are mixed with solubilizing agents such as CREMOPHOR®, alcohols, oils, modified oils, glycols, polysorbates, cyclodextrins, polymers, and/or combinations thereof. In other embodiments, surfactants are included such as hydroxypropylcellulose.

Injectable preparations, for example, sterile injectable aqueous or oleaginous suspensions may be formulated according to the known art using suitable dispersing agents, wetting agents, and/or suspending agents. Sterile injectable preparations may be sterile injectable solutions, suspensions, and/or emulsions in nontoxic parenterally acceptable diluents and/or solvents, for example, as a solution in 1,3-butanediol. Among the acceptable vehicles and solvents that may be employed are water, Ringer's solution, U.S.P., and isotonic sodium chloride solution. Sterile, fixed oils are conventionally employed as a solvent or suspending medium. For this purpose, any bland fixed oil can be employed including synthetic mono- or diglycerides. Fatty acids such as oleic acid can be used in the preparation of injectables.

Injectable formulations may be sterilized, for example, by filtration through a bacterial-retaining filter, and/or by incorporating sterilizing agents in the form of sterile solid compositions which can be dissolved or dispersed in sterile water or other sterile injectable medium prior to use.

In order to prolong the effect of active ingredients, it is often desirable to slow the absorption of active ingredients from subcutaneous or intramuscular injections. This may be accomplished by the use of liquid suspensions of crystalline or amorphous material with poor water solubility. The rate of absorption of active ingredients depends upon the rate of dissolution which, in turn, may depend upon crystal size and crystalline form. Alternatively, delayed absorption of a parenterally administered drug form is accomplished by dissolving or suspending the drug in an oil vehicle. Injectable depot forms are made by forming microencapsulated matrices of the drug in biodegradable polymers such as polylactide-polyglycolide. Depending upon the ratio of drug to polymer and the nature of the particular polymer employed, the rate of drug release can be controlled. Examples of other biodegradable polymers include poly(orthoesters) and poly (anhydrides). Depot injectable formulations are prepared by entrapping the drug in liposomes or microemulsions which are compatible with body tissues.

Ophthalmic or Otic Administration

In some embodiments, pharmaceutical compositions, CA2 biocircuits, CA2 biocircuit components, CA2 effector modules including their SREs or payloads of the present disclosure may be prepared, packaged, and/or sold in formulations suitable for ophthalmic and/or otic administration. Such formulations may, for example, be in the form of eye and/or ear drops including, for example, a 0.1/1.0% (w/w) solution and/or suspension of the active ingredient in aqueous and/or oily liquid excipients. Such drops may further comprise buffering agents, salts, and/or one or more other of any additional ingredients described herein. Other ophthalmically-administrable formulations which are useful include those which comprise active ingredients in microcrystalline form and/or in liposomal preparations. Subretinal inserts may also be used as forms of administration.

Detectable Agents and Labels

The stimuli, CA2 biocircuit systems and components, CA2 effector modules including the SREs and payloads may be associated with or bound to one or more radioactive agents or detectable agents.

These agents include various organic small molecules, inorganic compounds, nanoparticles, enzymes or enzyme substrates, fluorescent materials, luminescent materials (e.g., luminol), bioluminescent materials (e.g., luciferase, luciferin, and aequorin), chemiluminescent materials, radioactive materials (e.g., $^{18}F$, $^{67}Ga$, $^{81m}Kr$, $^{82}Rb$, $^{111}In$, $^{123}I$, $^{133}Xe$, $^{201}Tl$, $^{125}I$, $^{35}S$, $^{14}C$, $^{3}H$, or $^{99m}Tc$ (e.g., as pertechnetate (technetate (VII), $TcO_4^-$)), and contrast agents (e.g., gold (e.g., gold nanoparticles), gadolinium (e.g., chelated Gd), iron oxides (e.g., superparamagnetic iron oxide (SPIO), monocrystalline iron oxide nanoparticles (MIONs), and ultrasmall superparamagnetic iron oxide (USPIO)), manganese chelates (e.g., Mn-DPDP), barium sulfate, iodinated contrast media (iohexol), microbubbles, or perfluorocarbons).

In some embodiments, the detectable agent may be a non-detectable precursor that becomes detectable upon activation (e.g., fluorogenic tetrazine-fluorophore constructs (e.g., tetrazine-BODIPY FL, tetrazine-Oregon Green 488, or tetrazine-BODIPY TMR-X) or enzyme activatable fluorogenic agents (e.g., PROSENSE® (VisEn Medical))). In vitro assays in which the enzyme labeled compositions can be used include, but are not limited to, enzyme linked immunosorbent assays (ELISAs), immunoprecipitation assays, immunofluorescence, enzyme immunoassays (EIA), radioimmunoassays (RIA), and Western blot analysis.

Kits

The present disclosure includes a variety of kits for conveniently and/or effectively carrying out methods of the present disclosure. Typically, kits will comprise sufficient amounts and/or numbers of components to allow a user to perform one or multiple treatments of a subject(s) and/or to perform one or multiple experiments.

In one embodiment, the present disclosure provides kits for inhibiting genes in vitro or in vivo, comprising a CA2 biocircuit of the present disclosure or a combination of CA2 biocircuits of the present disclosure, optionally in combination with any other suitable active agents.

The kit may further comprise packaging and instructions and/or a delivery agent to form a formulation composition. The delivery agent may comprise, for example, saline, a buffered solution.

In additional embodiments, assay screening kits are provided. The kit includes a container for the screening assay. An instruction for the use of the assay and the information about the screening method are to be included in the kit.

IV. Applications

The CA2 biocircuits, CA2 effector modules, SREs, stimuli, compositions or systems comprising one or more of the stimuli, CA2 biocircuits, CA2 effector modules of the present disclosure may be utilized in a large variety of applications including, but not limited to, therapeutics, diagnosis and prognosis, bioengineers, bioprocessing, biofactory, research agents, metabolomics, gene expression, enzyme replacement, etc.

Therapeutic Uses

Cancer Immunotherapy

Cancer immunotherapy aims at the induction or restoration of the reactivity of the immune system towards cancer. Significant advances in immunotherapy research have led to the development of various strategies which may broadly be classified into active immunotherapy and passive immunotherapy. In general, these strategies may be utilized to directly kill cancer cells or to counter the immunosuppressive tumor microenvironment. Active immunotherapy aims at induction of an endogenous, long-lasting tumor-antigen specific immune response. The response can further be enhanced by non-specific stimulation of immune response modifiers such as cytokines. In contrast, passive immunotherapy includes approaches where effector immune molecules such as tumor-antigen specific cytotoxic T cells or antibodies are administered to the host. This approach is short lived and requires multiple applications.

Despite significant advances, the efficacy of current immunotherapy strategies is limited by associated toxicities. These are often related to the narrow therapeutic window associated with immunotherapy, which in part, emerges from the need to push therapy dose to the edge of potentially fatal toxicity to get a clinically meaningful treatment effect. Further, dose expands in vivo since adoptively transferred immune cells continue to proliferate within the patient, often unpredictably.

A major risk involved in immunotherapy is the on-target but off tumor side effects resulting from T-cell activation in response to normal tissue expression of the tumor associated antigen (TAA). Clinical trials utilizing T cells expressing T-cell receptor against specific TAA reported skin rash, colitis and hearing loss in response to immunotherapy.

Immunotherapy may also produce on target, on-tumor toxicities that emerge when tumor cells are killed in response to the immunotherapy. The adverse effects include tumor lysis syndrome, cytokine release syndrome and the related macrophage activation syndrome. Importantly, these adverse effects may occur during the destruction of tumors, and thus even a successful on-tumor immunotherapy might result in toxicity. Approaches to regulatably control immunotherapy are thus highly desirable since they have the potential to reduce toxicity and maximize efficacy.

The present disclosure provides systems, compositions, immunotherapeutic agents and methods for cancer immunotherapy. These compositions provide tunable regulation of gene expression and function in immunotherapy. The present disclosure also provides CA2 biocircuit systems, CA2 effector modules, stimulus response elements (SREs) and payloads, as well as polynucleotides encoding any of the foregoing. In one aspect, the systems, compositions, immunotherapeutic agents and other components described herein can be controlled by a separately added stimulus, which provides a significant flexibility to regulate cancer immunotherapy. Further, the systems, compositions and the methods of the present disclosure may also be combined with therapeutic agents such as chemotherapeutic agents, small molecules, gene therapy, and antibodies.

The tunable nature of the systems and compositions described herein has the potential to improve the potency and duration of the efficacy of immunotherapies. Reversibly silencing the biological activity of adoptively transferred cells using compositions of the present disclosure allows maximizing the potential of cell therapy without irretrievably killing and terminating the therapy.

The present disclosure provides methods for fine tuning of immunotherapy after administration to patients. This in turn improves the safety and efficacy of immunotherapy and increases the subject population that may benefit from immunotherapy.

In one embodiment, the CA2 biocircuit systems, CA2 effector modules, SREs, and components that tune expression levels and activities of any agents may be used for immunotherapy. As non-limiting examples, an immunotherapeutic agent may be an antibody and fragments and variants thereof, a cancer specific T cell receptor (TCR) and variants thereof, an anti-tumor specific chimeric antigen receptor (CAR), a chimeric switch receptor, an inhibitor of a co-inhibitory receptor or ligand, an agonist of a co-stimulatory receptor and ligand, a cytokine, chemokine, a cytokine receptor, a chemokine receptor, a soluble growth factor, a metabolic factor, a suicide gene, a homing receptor, or any agent that induces an immune response in a cell and a subject.

In some embodiments, the composition for inducing an immune response may comprise an CA2 effector module. In some embodiments, the CA2 effector module may comprise a stimulus response element (SRE) operably linked to at least one payload. In one aspect, the payload may be an immunotherapeutic agent.

In some embodiments, CA2 biocircuit systems, CA2 effector modules, and compositions of the present disclosure relate to post-translational regulation of protein (payload) function anti-tumor immune responses of immunotherapeutic agents.

1. Adoptive Cell Transfer (Adoptive Immunotherapy)

In some embodiments, cells which are genetically modified to express at least one CA2 biocircuit system, CA2 effector module, SRE, and/or payload of interest (e.g., immunotherapeutic agent) may be used for adoptive cell therapy (ACT). As used herein, Adoptive cell transfer refers to the administration of immune cells (from autologous, allogenic or genetically modified hosts) with direct anticancer activity. ACT has shown promise in clinical application against malignant and infectious disease. For example, T cells genetically engineered to recognize CD19 have been used to treat follicular B cell lymphoma (Kochenderfer et al., *Blood*, 2010, 116:4099-4102; and Kochenderfer and Rosenberg, *Nat Rev Clin Oncol.*, 2013, 10(5): 267-276) and ACT using autologous lymphocytes genetically-modified to express anti-tumor T cell receptors has been used to treat metastatic melanoma (Rosenberg and Dudley, *Curr. Opin. Immunol.* 2009, 21: 233-240).

According to the present disclosure, the CA2 biocircuits and systems may be used in the development and implementation of cell therapies such as adoptive cell therapy. Certain effector modules useful in cell therapy are given in FIGS. 7-12 in International Publication No. WO2017/180587, the contents of which are herein incorporated by reference in their entirety. The CA2 biocircuits, CA2 effector modules and their SREs and payloads may be used in cell therapies to effect CAR therapies, in the manipulation or regulation of TILs, in allogeneic cell therapy, in combination T cell therapy with other treatment lines (e.g. radiation, cytokines), to encode engineered TCRs, or modified TCRs, or to enhance T cells other than TCRs (e.g. by introducing cytokine genes, genes for the checkpoint inhibitors PD1, CTLA4).

Provided herein are methods for use in adoptive cell therapy. The methods involve preconditioning a subject in need thereof, modulating immune cells with SRE, CA2 biocircuits and compositions of the present disclosure, administering to a subject, engineered immune cells expressing compositions described herein and the successful engraftment of engineered cells within the subject.

In some embodiments, SREs, CA2 biocircuits and compositions of the present disclosure may be used to minimize preconditioning regimens associated with adoptive cell therapy. As used herein "preconditioning" refers to any therapeutic regimen administered to a subject to improve the outcome of adoptive cell therapy. Preconditioning strategies include but are not limited to total body irradiation and/or lymphodepleting chemotherapy. Adoptive therapy clinical trials without preconditioning have failed to demonstrate any clinical benefit, indicating its importance in ACT. Yet, preconditioning is associated with significant toxicity and limits the subject cohort that is suitable for ACT. In some instances, immune cells for ACT may be engineered to express cytokines such as IL12 and IL15 as payload using SREs of the present disclosure to reduce the need for preconditioning (Pengram et al. (2012) Blood 119 (18): 4133-41; the contents of which are incorporated by reference in their entirety).

In some embodiments, immune cells for ACT may be dendritic cells, T cells such as CD8' T cells and CD4+ T cells, natural killer (NK) cells, NK T cells, Cytotoxic T lymphocytes (CTLs), tumor infiltrating lymphocytes (TILs), lymphokine activated killer (LAK) cells, memory T cells, regulatory T cells (Tregs), helper T cells, cytokine-induced killer (CIK) cells, and any combination thereof. In other embodiments, immune stimulatory cells for ACT may be generated from embryonic stem cell (ESC) and induced pluripotent stem cell (iPSC). In some embodiments, autologous or allogeneic immune cells are used for ACT.

In some embodiments, cells used for ACT may be T cells engineered to express CARs comprising an antigen-binding domain specific to an antigen on tumor cells of interest. In other embodiments, cells used for ACT may be NK cells engineered to express CARs comprising an antigen-binding domain specific to an antigen on tumor cells of interest. In addition to adoptive transfer of genetically modified T cells (e.g., CAR T cells) for immunotherapy, alternate types of CAR-expressing leukocytes, either alone, or in combination with CAR T cells may be used for adoptive immunotherapy. In one example, a mixture of T cells and NK cells may be used for ACT. The expression level of CARs in T cells and NK cells, according to the present disclosure, is tuned and controlled by a small molecule that binds to the DD(s) operably linked to the CAR in the CA2 effector module.

In some embodiments, the CARs of the present disclosure may be placed under the transcriptional control of the T cell receptor alpha constant (TRAC) locus in the T cells to achieve uniform CAR expression while enhancing T cell potency. The TRAC locus may be disrupted using the CRISPR/Cas 9, zinc finger nucleases (ZFNs), TALENs followed by the insertion of the CAR construct. Methods of engineering CAR constructs directed to the TRAC locus are described in Eyquem J. et al (2017) Nature. 543(7643):113-117 (the contents of which are incorporated herein by reference in their entirety).

In some embodiments, NK cells engineered to express the present compositions may be used for ACT. NK cell activation induces perforin/granzyme-dependent apoptosis in target cells. NK cell activation also induces cytokine secretion such as IFN γ, TNF-α and GM-CSF. These cytokines enhance the phagocytic function of macrophages and their antimicrobial activity and augment the adaptive immune response via up-regulation of antigen presentation by antigen presenting cells such as dendritic cells (DCs) (Reviewed by Vivier et al., *Nat. Immunol.*, 2008, 9(5): 503-510).

Other examples of genetic modification may include the introduction of chimeric antigen receptors (CARs) and the down-regulation of inhibitory NK cell receptors such as NKG2A.

NK cells may also be genetically reprogrammed to circumvent NK cell inhibitory signals upon interaction with tumor cells. For example, using CRISPR, ZFN, or TALEN to genetically modify NK cells to silence their inhibitory receptors may enhance the anti-tumor capacity of NK cells.

Immune cells can be isolated and expanded ex vivo using a variety of methods known in the art. For example, methods of isolating and expanding cytotoxic T cells are described in U.S. Pat. Nos. 6,805,861 and 6,531,451; US Patent Publication No. US20160348072A1 and International Patent Publication NO. WO2016168595A1; the contents of each of which are incorporated herein by reference in their entirety. Isolation and expansion of NK cells is described in US Patent Publication No. US20150152387A1, U.S. Pat. No. 7,435,596; and Oyer, J. L. (2016). Cytotherapy. 18(5):653-63; the contents of each of which are incorporated by reference herein in its entirety. Specifically, human primary NK cells may be expanded in the presence of feeder cells e.g. a myeloid cell line that has been genetically modified to express membrane bound IL15, IL21, IL12 and 4-1BBL.

In some instances, sub populations of immune cells may be enriched for ACT. Methods for immune cell enrichment are taught in International Patent Publication NO. WO2015039100A1. In another example, T cells positive for B and T lymphocyte attenuator marker BTLA) may be used to enrich for T cells that are anti-cancer reactive as described in U.S. Pat. No. 9,512,401 (the content of each of which are incorporated herein by reference in their entirety).

In some embodiments, immune cells for ACT may be depleted of select sub populations to enhance T cell expansion. For example, immune cells may be depleted of Foxp3+ T lymphocytes to minimize the anti-tumor immune response using methods taught in US Patent Publication No. US 20160298081A1; the contents of which are incorporated by reference herein in their entirety.

In some embodiments, activation and expansion of T cells for ACT is achieved antigenic stimulation of a transiently expressed Chimeric Antigen Receptor (CAR) on the cell surface. Such activation methods are taught in International Patent NO. WO2017015427, the content of which are incorporated herein by reference in their entirety.

In some embodiments, immune cells may be activated by antigens associated with antigen presenting cells (APCs). In some embodiments, the APCs may be dendritic cells, macrophages or B cells that are antigen specific or nonspecific. The APCs may be autologous or homologous in their organ. In some embodiments, the APCs may be artificial antigen presenting cells (aAPCs) such as cell based aAPCs or acellular aAPCs. Cell based aAPCs may be selected from either genetically modified allogeneic cells such as human erythroleukemia cells or xenogeneic cells such as murine fibroblasts and Drosophila cells. Alternatively, the APCs maybe be acellular wherein the antigens or costimulatory domains are presented on synthetic surfaces such as latex beads, polystyrene beads, lipid vesicles or exosomes.

In some embodiments, cells described herein, specifically T cells may be expanded using artificial cell platforms. In one embodiment, the mature T cells may be generated using artificial thymic organoids (ATOs) described by Seet C S et al. 2017. *Nat Methods.* 14, 521-530 (the contents of which are incorporated herein by reference in their entirety). ATOs are based on a stromal cell line expressing delta like canonical notch ligand (DLL1). In this method, stromal cells are aggregated with hematopoietic stem and progenitor cells by centrifugation and deployed on a cell culture insert at the air-fluid interface to generate organoid cultures. ATO-derived T cells exhibit naive phenotypes, a diverse T cell receptor (TCR) repertoire and TCR-dependent function.

In some embodiments, adoptive cell therapy is carried out by autologous transfer, wherein the cells are derived from a subject in need of a treatment and the cells, following isolation and processing are administered to the same subject. In other instances, ACT may involve allogenic transfer wherein the cells are isolated and/or prepared from a donor subject other than the recipient subject who ultimately receives cell therapy. The donor and recipient subject may be genetically identical, or similar or may express the same HLA class or subtype.

In some embodiments, the multiple immunotherapeutic agents introduced into the immune cells for ACT (e.g., T cells and NK cells) may be controlled by the same CA2 biocircuit system. In one example, a cytokine such as mbIL12 and a CAR construct such as CD19 CAR are linked to the same CA2 destabilizing domain. The expression of mbIL12 and CD19 CAR is tuned using the same stimuli simultaneously. In other embodiments, the multiple immunotherapeutic agents introduced into the immune cells for ACT (e.g., T cells and NK cells) may be controlled by different biocircuit systems. In another example, a cytokine such as mbIL12 is linked to a CA2 DD as provided herein, and a different immunotherapeutic agent, such as a CAR, for example, a CD19 CAR, is not regulated by a DD, and is expressed independently from the mbIL12. In another example, a suicide gene and a CAR construct may be linked to two separate effector modules.

Following genetic modulation using SREs, CA2 biocircuits and compositions described herein, cells are administered to the subject in need thereof. Methods for administration of cells for adoptive cell therapy are known and may be used in connection with the provided methods and compositions. For example, adoptive T cell therapy methods are described, e.g., in US Patent Application Publication No. 2003/0170238 to Gruenberg et al; U.S. Pat. No. 4,690,915 to Rosenberg; Rosenberg (2011) Nat Rev Clin Oncol. 8(10): 577-85). See, e.g., Themeli et al. (2013) Nat Biotechnol.

31(10): 928-933; Tsukahara et al. (2013) Biochem Biophys Res Commun 438(1): 84-9; Davila et al. (2013) PLoS ONE 8(4): e61338; the contents of each of which are incorporated herein by reference in their entirety.

In some embodiments, immune cells for ACT may be modified to express one or more immunotherapeutic agents which facilitate immune cells activation, infiltration, expansion, survival and anti-tumor functions. The immunotherapeutic agents may be a second CAR or TCR specific to a different target molecule; a cytokine or a cytokine receptor; a chimeric switch receptor that converts an inhibitory signal to a stimulatory signal; a homing receptor that guides adoptively transferred cells to a target site such as the tumor tissue; an agent that optimizes the metabolism of the immune cell; or a safety switch gene (e.g., a suicide gene) that kills activated T cells when a severe event is observed after adoptive cell transfer or when the transferred immune cells are no-longer needed.

In some embodiments, immune cells used for adoptive cell transfer can be genetically manipulated to improve their persistence, cytotoxicity, tumor targeting capacity, and ability to home to disease sites in vivo, with the overall aim of further improving upon their capacity to kill tumors in cancer patients. One example is to introduce CA2 effector modules described herein comprising cytokines such as gamma-cytokines (IL2 and IL15) into immune cells to promote immune cell proliferation and survival. Transduction of cytokine genes (e.g., gamma-cytokines IL2 and IL15) into cells will be able to propagate immune cells without addition of exogenous cytokines and cytokine expressing NK cells have enhanced tumor cytotoxicity.

In some embodiments, CA2 biocircuits, SREs or CA2 effector modules may be utilized to prevent T cell exhaustion. As used herein, "T cell exhaustion" refers to the stepwise and progressive loss of T cell function caused by chronic T cell activation. T cell exhaustion is a major factor limiting the efficacy of antiviral and antitumor immunotherapies. Exhausted T cells have low proliferative and cytokine producing capabilities concurrent with high rates of apoptosis and high surface expression of multiple inhibitory receptors. T cell activation leading to exhaustion may occur either in the presence or absence of the antigen.

In some embodiments, the CA2 biocircuits, and their components may be utilized to prevent T cell exhaustion in the context of Chimeric Antigen Receptor-T cell therapy (CAR-T). In this context, exhaustion in some instances, may be caused by the oligomerization of the scFvs of the CAR on the cell surface which leads to continuous activation of the intracellular domains of the CAR. As a non-limiting example, CARs of the present disclosure may include scFvs that are unable to oligomerize. As another non-limiting example, CARs that are rapidly internalized and re-expressed following antigen exposure may also be selected to prevent chronic scFv oligomerization on cell surface. In one embodiment, the framework region of the scFvs may be modified to prevent constitutive CAR signaling (Long et al. 2014. Cancer Research. 74(19) S1; the contents of which are incorporated by reference in their entirety). Tunable CA2 biocircuit systems of the present disclosure may also be used to regulate the surface expression of the CAR on the T cell surface to prevent chronic T cell activation. The CARs described herein may also be engineered to minimize exhaustion. As a non-limiting example, the 41-BB signaling domain may be incorporated into CAR design to ameliorate T cell exhaustion. In some embodiments, any of the strategies disclosed by Long H A et al. may be utilized to prevent exhaustion (Long A H et al. (2015) Nature Medicine 21, 581-590; the contents of which are incorporated herein by reference in their entirety).

In some embodiments, the tunable nature of the CA2 biocircuits of the present disclosure may be utilized to reverse human T cell exhaustion observed with tonic CAR signaling. Reversibly silencing the biological activity of adoptively transferred cells using compositions of the present disclosure may be used to reverse tonic signaling which, in turn, may reinvigorate the T cells. Reversal of exhaustion may be measured by the downregulation of multiple inhibitory receptors associated with exhaustion.

In some embodiments, T cell metabolic pathways may be modified to diminish the susceptibility of T cells to exhaustion. Metabolic pathways may include, but are not limited to glycolysis, urea cycle, citric acid cycle, beta oxidation, fatty acid biosynthesis, pentose phosphate pathway, nucleotide biosynthesis, and glycogen metabolic pathways. As a non-limiting example, payloads that reduce the rate of glycolysis may be utilized to restrict or prevent T cell exhaustion (Long et al. Journal for Immunotherapy of Cancer 2013, 1(Suppl 1): P21; the contents of which are incorporated by reference in their entirety). In one embodiment, T cells of the present disclosure may be used in combination with inhibitors of glycolysis such as 2-deoxyglucose, and rapamycin.

In some embodiments, CA2 effector modules of the present disclosure, useful for immunotherapy may be placed under the transcriptional control of the T cell receptor alpha locus constant (TRAC) locus in the T cells. Eyquem et al. have shown that expression of the CAR from the TRAC locus prevents T cell exhaustion and the accelerated differentiation of T cells caused by excessive T cell activation (Eyquem J. et al (2017) Nature. 543(7643):113-117; the contents of which are incorporated herein by reference in their entirety).

In some embodiments, payloads described herein may be used in conjunction with antibodies or fragments that target T cell surface markers associated with T cell exhaustion. T-cell surface markers associated with T cell exhaustion that may be used include, but are not limited to, CTLA-1, PD-1, TGIT, LAG-3, 2B4, BTLA, TIM3, VISTA, and CD %.

In one embodiment, the payload described herein may be a CD276 CAR (with CD28, 4-IBB, and CD3 zeta intracellular domains), that does not show an upregulation of the markers associated with early T cell exhaustion (see International patent publication No. WO2017044699; the contents of which are incorporated by reference in their entirety).

In some embodiments, the compositions of the present disclosure may be utilized to alter TIL (tumor infiltrating lymphocyte) populations in a subject. In one embodiment, any of the payloads described herein may be utilized to change the ratio of CD4 positive cells to CD8 positive populations. In some embodiments, TILs may be sorted ex vivo and engineered to express any of the cytokines described herein. Payloads described herein may be used to expand CD4 and/or CD8 populations of TILs to enhance TIL mediated immune response.

2. Cancer Vaccines

In some embodiments, CA2 biocircuits, CA2 effector modules, payloads of interest (e.g., immunotherapeutic agents), vectors, cells and compositions of the present disclosure may be used in conjunction with cancer vaccines.

In some embodiments, cancer vaccine may comprise peptides and/or proteins derived from tumor associated antigen (TAA). Such strategies may be utilized to evoke an immune response in a subject, which in some instances may be a cytotoxic T lymphocyte (CTL) response. Peptides used for cancer vaccines may also modified to match the mutation profile of a subject. For example, EGFR derived peptides with mutations matched to the mutations found in the subject in need of therapy have been successfully used in patients with lung cancer (Li F et al. (2016) Oncoimmunology. October 7; 5(12): e1238539; the contents of which are incorporated herein by reference in their entirety).

In one embodiment, cancer vaccines of the present disclosure may be superagonist altered peptide ligands (APL) derived from TAAs. These are mutant peptide ligands-that-deviate from the native peptide sequence by one or more amino acids, which activate specific CTL clones more effectively than native epitopes. These alterations may allow the peptide to bind better to the restricting Class I MHC molecule or interact more favorably with the TCR of a given tumor-specific CTL subset. APLs may be selected using methods taught in US Patent Publication No. US20160317633A1, the contents of which are incorporated herein by reference in their entirety.

3. Combination Treatments

In some embodiments, it is desirable to combine compositions, vectors and cells described herein for administration to a subject. Compositions described herein comprising different immunotherapeutic agents may be used in combination for enhancement of immunotherapy.

In some embodiments, it is desirable to combine compositions described herein with adjuvants, that can enhance the potency and longevity of antigen-specific immune responses. Adjuvants used as immunostimulants in combination therapy include biological molecules or delivery carriers that deliver antigens. As non-limiting examples, the compositions of the present disclosure may be combined with biological adjuvants such as cytokines, Toll Like Receptors, bacterial toxins, and/or saponins. In other embodiments, the compositions of the present disclosure may be combined with delivery carriers. Exemplary delivery carriers include, polymer microspheres, immune stimulating complexes, emulsions (oil-in-water or water-in-oil), aluminum salts, liposomes or virosomes.

In some embodiments, effector immune cells modified to express CA2 biocircuits, CA2 effector modules, SREs and payloads described herein may be combined with the biological adjuvants described herein. Dual regulation of CAR and cytokines and ligands to segregate the kinetic control of target-mediated activation from intrinsic cell T cell expansion. Such dual regulation also minimizes the need for pre-conditioning regimens in patients In some embodiments, effector immune cells modified to express one or more antigen-specific TCRs or CARs may be combined with compositions described herein comprising immunotherapeutic agents that convert the immunosuppressive tumor microenvironment.

In one aspect, effector immune cells modified to express CARs specific to different target molecules on the same cell may be combined. In another aspect, different immune cells modified to express the same CAR construct such as NK cells and T cells may be used in combination for a tumor treatment, for instance, a T cell modified to express a CD19 CAR may be combined with a NK cell modified to express the same CD19 CAR to treat B cell malignancy.

In other embodiments, immune cells modified to express CARs may be combined with checkpoint blockade agents.

In some embodiments, effector immune cells modified to expressed CA2 biocircuits, CA2 effector modules, SREs and payloads described herein may be combined with cancer vaccines described herein.

In some embodiments, methods of the present disclosure may include combination of the compositions of the present disclosure with other agents effective in the treatment of cancers, infectious diseases and other immunodeficient disorders, such as anti-cancer agents. As used herein, the term "anti-cancer agent" refers to any agent which is capable of negatively affecting cancer in a subject, for example, by killing cancer cells, inducing apoptosis in cancer cells, reducing the growth rate of cancer cells, reducing the incidence or number of metastases, reducing tumor size, inhibiting tumor growth, reducing the blood supply to a tumor or cancer cells, promoting an immune response against cancer cells or a tumor, preventing or inhibiting the progression of cancer, or increasing the lifespan of a subject with cancer.

In some embodiments, anti-cancer agent or therapy may be a chemotherapeutic agent, or radiotherapy, immunotherapeutic agent, surgery, or any other therapeutic agent which, in combination with the present disclosure, improves the therapeutic efficacy of treatment.

In one embodiment, a CA2 effector module comprising a CD19 CAR may be used in combination with amino pyrimidine derivatives such as the Burkitt's tyrosine receptor kinase (BTK) inhibitor using methods taught in International Patent Application NO. WO2016164580, the contents of which are incorporated herein by reference in their entirety.

In some embodiments, compositions of the present disclosure may be used in combination with immunotherapeutics other than the inventive therapy described herein, such as antibodies specific to some target molecules on the surface of a tumor cell.

Exemplary chemotherapies include, without limitation, Acivicin; Aclarubicin; Acodazole hydrochloride; Acronine; Adozelesin; Aldesleukin; Altretamine; Ambomycin; Ametantrone acetate; Amsacrine; Anastrozole; Anthramycin; Asparaginase; Asperrin, Sulindac, Curcumin, alkylating agents including: Nitrogen mustards such as mechlorethamine, cyclophosphamide, ifosfamide, melphalan and chlorambucil; nitrosoureas such as carmustine (BC U), lomustine (CCNU), and semustine (methyl-CC U); thylenimines/methylmelamine such as thriethylenemelamine (TEM), triethylene, thiophosphoramide (thiotepa), hexamethylmelamine (HMM, altretamine); alkyl sulfonates such as busulfan; triazines such as dacarbazine (DTIC); antimetabolites including folic acid analogs such as methotrexate and trimetrexate, pyrrolidine analogs such as 5-fluorouracil, fluorodeoxyuridine, gemcitabine, cytosine arabinoside (AraC, cytarabine), 5-azacytidine, 2,2'-difluorodeoxycytidine, purine analogs such as 6-mercaptopurine, 6-thioguanie, azathioprine, 2'-deoxycoformycin (pentostatin), erythrohydroxynonyladenine (EHNA), fludarabine phosphate, and 2-chlorodeoxyadenosine (cladribine, 2-CdA); natural products including antrimitotic drugs such as paclitaxel, *vinca* alkaloids including vinblastine (VLB), vincristine, and vinorelbine, taxotere, estramustine, and estramustine phosphate; epipodophylotoxins such as etoposide and teniposide; antibiotics, such as actimomycin D, daunomycin (rubidomycin), doxorubicin, mitoxantrone, idarubicin, bleomycins, plicamycin (mithramycin), mitomycinC, and actinomycin; enzymes such as L-asparaginase, cytokines such as interferon (IFN)-gamma, tumor necrosis factor (TNF)-alpha, TNF-beta and GM-CSF, anti-angiogenic factors, such as angiostatin and endostatin, inhibitors of FGF or VEGF such as soluble forms of receptors for angiogenic factors, including soluble VGF/VEGF receptors, platinum coordination complexes such as cisplatin and carboplatin, anthracenediones such as mitoxantrone, substituted urea such as hydroxyurea, methylhydrazine derivatives including N-methylhydrazine (MIFf) and procarbazine, adrenocortical suppressants such as mitotane (o,ρ'-DDD) and aminoglutethimide; hormones and antagonists including adrenocorticosteroid antagonists such as prednisone and equivalents, dexamethasone and aminoglutethimide; progestin such as hydroxyprogesterone caproate, medroxyprogesterone acetate and megestrol acetate; estrogen such as diethylstilbestrol and ethinyl estradiol equivalents; antiestrogen such as tamoxifen; androgens including testosterone propionate and fluoxymesterone/equivalents; antiandrogens such as flutamide, gonadotropin-releasing hormone analogs and leuprolide; non-steroidal antiandrogens such as flutamide; kinase inhibitors, histone deacetylase inhibitors, methylation inhibitors, proteasome inhibitors, monoclonal antibodies, oxidants, anti-oxidants, telomerase inhibitors, BH3 mimetics, ubiquitin ligase inhibitors, stat inhibitors and receptor tyrosin kinase inhibitors such as imatinib mesylate (marketed as Gleevac or Glivac) and erlotinib (an EGF receptor inhibitor) now marketed as Tarveca; anti-virals such as oseltamivir phosphate, Amphotericin B, and palivizumab; Sdi 1 mimetics; Semustine; Senescence derived inhibitor 1; Sparfosic acid; Spicamycin D; Spiromustine; Splenopentin; Spongistatin 1; Squalamine; Stipiamide; Stromelysin inhibitors; Sulfinosine; Superactive vasoactive intestinal peptide antagonist; Velaresol; Veramine; Verdins; Verteporfin; Vinorelbine; Vinxaltine; Vitaxin; Vorozole; Zanoterone; Zeniplatin; Zilascorb; and Zinostatin stimalamer, PI3Kβ small-molecule inhibitor, GSK2636771; pan-PI3K inhibitor (BKM120); BRAF inhibitors. Vemurafenib (Zelboraf) and dabrafenib (Tafinlar); or any analog or derivative and variant of the foregoing.

Radiotherapeutic agents and factors include radiation and waves that induce DNA damage for example, γ-irradiation, X-rays, UV-irradiation, microwaves, electronic emissions, radioisotopes, and the like. Therapy may be achieved by irradiating the localized tumor site with the above described forms of radiations. It is most likely that all of these factors effect a broad range of damage DNA, on the precursors of DNA, the replication and repair of DNA, and the assembly and maintenance of chromosomes. Dosage ranges for X-rays range from daily doses of 50 to 200 roentgens for prolonged periods of time (3 to 4 weeks), to single doses of 2000 to 6000 roentgens. Dosage ranges for radioisotopes vary widely, and depend on the half-life of the isotope, the strength and type of radiation emitted, and the uptake by the neoplastic cells.

In some embodiments, the chemotherapeutic agent may be an immunomodulatory agent such as lenalidomide (LEN). Recent studies have demonstrated that lenalidomide can enhance antitumor functions of CAR modified T cells (Otahal et al., *Oncoimmunology*, 2015, 5(4): e1115940). Some examples of anti-tumor antibodies include tocilizumab, siluximab.

Other agents may be used in combination with compositions of the present disclosure may also include, but not limited to, agents that affect the upregulation of cell surface receptors and their ligands such as Fas/Fas ligand, DR4 or DR5/TRAIL and GAP junctions, cytostatic and differentiation agents, inhibitors of cell adhesion such as focal adhesion kinase (FAKs) inhibitors and Lovastatin, or agents that increase the sensitivity of the hyper proliferative cells to apoptotic inducers such as the antibody C225.

The combinations may include administering the compositions of the present disclosure and other agents at the same time or separately. Alternatively, the present immunotherapy may precede or follow the other agent/therapy by intervals ranging from minutes, days, weeks to months.

4. Diseases

Provided in the present disclosure is a method of reducing a tumor volume or burden in a subject in need, the method comprising introducing into the subject a composition described herein.

The present disclosure also provides methods for treating a cancer in a subject, comprising administering to the subject an effective amount of an effector immune cell genetically modified to express at least one CA2 effector module described herein.

Cancer

Various cancers may be treated with pharmaceutical compositions, CA2 biocircuits, CA2 biocircuit components, CA2 effector modules including their SREs or payloads of the present disclosure. As used herein, the term "cancer" refers to any of various malignant neoplasms characterized by the proliferation of anaplastic cells that tend to invade surrounding tissue and metastasize to new body sites and also refers to the pathological condition characterized by such malignant neoplastic growths. Cancers may be tumors or hematological malignancies, and include but are not limited to, all types of lymphomas/leukemias, carcinomas and sarcomas, such as those cancers or tumors found in the anus, bladder, bile duct, bone, brain, breast, cervix, colon/ rectum, endometrium, esophagus, eye, gallbladder, head and neck, liver, kidney, larynx, lung, mediastinum (chest), mouth, ovaries, pancreas, penis, prostate, skin, small intestine, stomach, spinal marrow, tailbone, testicles, thyroid and uterus.

Types of carcinomas which may be treated with the compositions of the present disclosure include, but are not limited to, papilloma/carcinoma, choriocarcinoma, endodermal sinus tumor, teratoma, adenoma/adenocarcinoma, melanoma, fibroma, lipoma, leiomyoma, rhabdomyoma, mesothelioma, angioma, osteoma, chondroma, glioma, lymphoma/leukemia, squamous cell carcinoma, small cell carcinoma, large cell undifferentiated carcinomas, basal cell carcinoma and sinonasal undifferentiated carcinoma.

Types of sarcomas which may be treated with the compositions of the present disclosure include, but are not limited to, soft tissue sarcoma such as alveolar soft part sarcoma, angiosarcoma, dermatofibrosarcoma, desmoid tumor, desmoplastic small round cell tumor, extraskeletal chondrosarcoma, extraskeletal osteosarcoma, fibrosarcoma, hemangiopericytoma, hemangiosarcoma, Kaposi's sarcoma, leiomyosarcoma, liposarcoma, lymphangiosarcoma, lymphosarcoma, malignant fibrous histiocytoma, neurofibrosarcoma, rhabdomyosarcoma, synovial sarcoma, and Askin's tumor, Ewing's sarcoma (primitive neuroectodermal tumor), malignant hemangioendothelioma, malignant schwannoma, osteosarcoma, and chondrosarcoma.

As a non-limiting example, the carcinoma which may be treated may be Acute granulocytic leukemia, Acute lymphocytic leukemia, Acute myelogenous leukemia, Adenocarcinoma, Adenosarcoma, Adrenal cancer, Adrenocortical carcinoma, Anal cancer, Anaplastic astrocytoma, Angiosarcoma, Appendix cancer, Astrocytoma, Basal cell carcinoma, B-Cell lymphoma), Bile duct cancer, Bladder cancer, Bone cancer, Bowel cancer, Brain cancer, Brain stem glioma, Brain tumor, Breast cancer, Carcinoid tumors, Cervical cancer, Cholangiocarcinoma, Chondrosarcoma, Chronic lymphocytic leukemia, Chronic myelogenous leukemia, Colon cancer, Colorectal cancer, Craniopharyngioma, Cutaneous lymphoma, Cutaneous melanoma, Diffuse astrocytoma, Ductal carcinoma in situ, Endometrial cancer, Ependymoma, Epithelioid sarcoma, Esophageal cancer, Ewing sarcoma, Extrahepatic bile duct cancer, Eye cancer, Fallopian tube cancer, Fibrosarcoma, Gallbladder cancer, Gastric cancer, Gastrointestinal cancer, Gastrointestinal carcinoid cancer, Gastrointestinal stromal tumors, General, Germ cell tumor, Glioblastoma multiforme, Glioma, Hairy cell leukemia, Head and neck cancer, Hemangioendothelioma, Hodgkin lymphoma, Hodgkin's disease, Hodgkin's lymphoma, Hypopharyngeal cancer, Infiltrating ductal carcinoma, Infiltrating lobular carcinoma, Inflammatory breast cancer, Intestinal Cancer, Intrahepatic bile duct cancer, Invasive/infiltrating breast cancer, Islet cell cancer, Jaw cancer, Kaposi sarcoma, Kidney cancer, Laryngeal cancer, Leiomyosarcoma, Leptomeningeal metastases, Leukemia, Lip cancer, Liposarcoma, Liver cancer, Lobular carcinoma in situ, Low-grade astrocytoma, Lung cancer, Lymph node cancer, Lymphoma, Male breast cancer, Medullary carcinoma, Medulloblastoma, Melanoma, Meningioma, Merkel cell carcinoma, Mesenchymal chondrosarcoma, Mesenchymous, Mesothelioma, Metastatic breast cancer, Metastatic melanoma, Metastatic squamous neck cancer, Mixed gliomas, Mouth cancer, Mucinous carcinoma, Mucosal melanoma, Multiple myeloma, Nasal cavity cancer, Nasopharyngeal cancer, Neck cancer, Neuroblastoma, Neuroendocrine tumors, Non-Hodgkin lymphoma, Non-Hodgkin's lymphoma, Non-small cell lung cancer, Oat cell cancer, Ocular cancer, Ocular melanoma, Oligodendroglioma, Oral cancer, Oral cavity cancer, Oropharyngeal cancer, Osteogenic sarcoma, Osteosarcoma, Ovarian cancer, Ovarian epithelial cancer, Ovarian germ cell tumor, Ovarian primary peritoneal carcinoma, Ovarian sex cord stromal tumor, Paget's disease, Pancreatic cancer, Papillary carcinoma, Paranasal sinus cancer, Parathyroid cancer, Pelvic cancer, Penile cancer, Peripheral nerve cancer, Peritoneal cancer, Pharyngeal cancer, Pheochromocytoma, Pilocytic astrocytoma, Pineal region tumor, Pineoblastoma, Pituitary gland cancer, Primary central nervous system lymphoma, Prostate cancer, Rectal cancer, Renal cell cancer, Renal pelvis cancer, Rhabdomyosarcoma, Salivary gland cancer, Sarcoma, Sarcoma, bone, Sarcoma, soft tissue, Sarcoma, uterine, Sinus cancer, Skin cancer, Small cell lung cancer, Small intestine cancer, Soft tissue sarcoma, Spinal cancer, Spinal column cancer, Spinal cord cancer, Spinal tumor, Squamous cell carcinoma, Stomach cancer, Synovial sarcoma, T-cell lymphoma), Testicular cancer, Throat cancer, Thymoma/thymic carcinoma, Thyroid cancer, Tongue cancer, Tonsil cancer, Transitional cell cancer, Transitional cell cancer, Transitional cell cancer, Triple-negative breast cancer, Tubal cancer, Tubular carcinoma, Ureteral cancer, Ureteral cancer, Urethral cancer, Uterine adenocarcinoma, Uterine cancer, Uterine sarcoma, Vaginal cancer, and Vulvar cancer.

Infectious Diseases

In some embodiments, CA2 biocircuits described herein may be used for the treatment of infectious diseases. CA2 biocircuits of the present disclosure may be introduced in cells suitable for adoptive cell transfer such as macrophages, dendritic cells, natural killer cells, and or T cells. Infectious diseases treated by the CA2 biocircuits of the present disclosure may be diseases caused by viruses, bacteria, fungi, and/or parasites. IL15-IL15Ra payloads of the present disclosure may be used to increase immune cell proliferation and/or persistence of the immune cells useful in treating infectious diseases.

"Infectious diseases" herein refer to diseases caused by any pathogen or agent that infects mammalian cells, preferably human cells and causes a disease condition. Examples thereof include bacteria, yeast, fungi, protozoans, mycoplasma, viruses, prions, and parasites. Examples include those involved in (a) viral diseases such as, for example, diseases resulting from infection by an adenovirus, a herpesvirus (e.g., HSV-I, HSV-II, CMV, or VZV), a poxvirus (e-g-, an orthopoxvirus such as variola or vaccinia, or molluscum contagiosum), a picornavirus (e.g., rhinovirus or enterovirus), an orthomyxovirus (e.g., influenzavirus), a paramyxovirus (e.g., parainfluenza virus, mumps virus, measles virus, and respiratory syncytial virus (RSV)), a coronavirus (e.g., SARS), a papovavirus (e.g., papillomaviruses, such as those that cause genital warts, common warts, or plantar warts), a hepadnavirus (e.g., hepatitis B virus), a flavivirus (e.g., hepatitis C virus or Dengue virus), or a retrovirus (e.g., a lentivirus such as HIV); (b) bacterial diseases such as, for example, diseases resulting from infection by bacteria of, for example, the genus *Escherichia, Enterobacter, Salmonella, Staphylococcus, Shigella, Listeria, Aerobacter, Helicobacter, Klebsiella, Proteus, Pseudomonas, Streptococcus, Chlamydia, Mycoplasma, Pneumococcus, Neisseria, Clostridium, Bacillus, Corynebacterium, Mycobacterium, Campylobacter, Vibrio, Serratia, Providencia, Chromobacterium, Brucella, Yersinia, Haemophilus,* or *Bordetella*; (c) other infectious diseases, such *Chlamydia,* fungal diseases including but not limited to candidiasis, aspergillosis, histoplasmosis, cryptococcal meningitis, parasitic diseases including but not limited to malaria, *Pneumocystis carnii* pneumonia, leishmaniasis, cryptosporidiosis, toxoplasmosis, and trypanosome infection and prions that cause human disease such as Creutzfeldt-Jakob Disease (CJD), variant Creutzfeldt-Jakob Disease (vCJD), Gerstmann-Straüssler-Scheinker syndrome, Fatal Familial Insomnia and kuru.

Combination Treatments

The present disclosure further relates to the use of pharmaceutical compositions, CA2 biocircuits, CA2 biocircuit components, CA2 effector modules including their SREs or payloads of the present disclosure for treating one or more forms of cancer, in combination with other pharmaceuticals and/or other therapeutic methods, e.g., with known pharmaceuticals and/or known therapeutic methods, such as, for example, those which are currently employed for treating these disorders. For example, the pharmaceutical compositions, CA2 biocircuits, CA2 biocircuit components, CA2 effector modules including their SREs or payloads of the present disclosure can also be administered in conjunction with one or more additional anti-cancer treatments, such as biological, chemotherapy and radiotherapy. Accordingly, a treatment can include, for example, imatinib (Gleevac), all-trans-retinoic acid, a monoclonal antibody treatment (gemtuzumab, ozogamicin), chemotherapy (for example, chlorambucil, prednisone, prednisolone, vincristine, cytarabine, clofarabine, farnesyl transferase inhibitors, decitabine, inhibitors of MDR1), rituximab, interferon-α, anthracycline drugs (such as daunorubicin or idarubicin), L-asparaginase, doxorubicin, cyclophosphamide, doxorubicin, bleomycin, fludarabine, etoposide, pentostatin, or cladribine), bone marrow transplant, stem cell transplant, radiation therapy, antimetabolite drugs (methotrexate and 6-mercaptopurine), or any of the antibodies taught in Table 5 of International Publication No. WO2017/180587 (the contents of which are herein incorporated by reference in their entirety) or combinations thereof.

Combinations with Radiation

Radiation therapy (also called radiotherapy, X-ray therapy, or irradiation) is the use of ionizing radiation to kill cancer cells and shrink tumors. Radiation therapy can be administered externally via external beam radiotherapy (EBRT) or internally via brachytherapy. The effects of radiation therapy are localized and confined to the region being treated. Radiation therapy may be used to treat almost every type of solid tumor, including cancers of the brain, breast, cervix, larynx, lung, pancreas, prostate, skin, stomach, uterus, or soft tissue sarcomas. Radiation is also used to treat leukemia and lymphoma.

Combination with Chemotherapy

Chemotherapy is the treatment of cancer with drugs that can destroy cancer cells. In current usage, the term "chemotherapy" usually refers to cytotoxic drugs which affect rapidly dividing cells in general, in contrast with targeted therapy. Chemotherapy drugs interfere with cell division in various possible ways, e.g. with the duplication of DNA or the separation of newly formed chromosomes. Most forms of chemotherapy target all rapidly dividing cells and are not specific to cancer cells, although some degree of specificity may come from the inability of many cancer cells to repair DNA damage, while normal cells generally can.

Most chemotherapy regimens are given in combination. Exemplary chemotherapeutic agents include, but are not limited to, 5-FU Enhancer, 9-AC, AG2037, AG3340, Aggrecanase Inhibitor, Aminoglutethimide, Amsacrine (m-AMSA), Asparaginase, Azacitidine, Batimastat (BB94), BAY 12-9566, BCH-4556, Bis-Naphtalimide, Busulfan, Capecitabine, Carboplatin, Carmustaine+Polifepr Osan, cdk4/cdk2 inhibitors, Chlorombucil, CI-994, Cisplatin, Cladribine, CS-682, Cytarabine HCl, D2163, Dactinomycin, Daunorubicin HCl, DepoCyt, Dexifosamide, Docetaxel, Dolastain, Doxifluridine, Doxorubicin, DX8951f, E 7070, EGFR, Epirubicin, Erythropoietin, Estramustine phosphate sodium, Etoposide (VP16-213), Farnesyl Transferase Inhibitor, FK 317, Flavopiridol, Floxuridine, Fludarabine, Fluorouracil (5-FU), Flutamide, Fragyline, Gemcitabine, Hexamethylmelamine (HMM), Hydroxyurea (hydroxycarbamide), Ifosfamide, Interferon Alfa-2a, Interferon Alfa-2b, Interleukin-2, Irinotecan, ISI 641, Krestin, Lemonal DP 2202, Leuprolide acetate (LHRH-releasing factor analogue), Levamisole, LiGLA (lithium-gamma linolenate), Lodine Seeds, Lometexol, Lomustine (CCNU), Marimistat, Mechlorethamine HCl (nitrogen mustard), Megestrol acetate, Meglamine GLA, Mercaptopurine, Mesna, Mitoguazone (methyl-GAG; methyl glyoxal bis-guanylhydrazone; MGBG), Mitotane (o.p'-DDD), Mitoxantrone, Mitoxantrone HCl, MMI 270, MMP, MTA/LY 231514, Octreotide, ODN 698, OK-432, Oral Platinum, Oral Taxoid, Paclitaxel (TAXOL®), PARP Inhibitors, PD 183805, Pentostatin (2' deoxycoformycin), PKC 412, Plicamycin, Procarbazine HCl, PSC 833, Ralitrexed, RAS Farnesyl Transferase Inhibitor, RAS Oncogene Inhibitor, Semustine (methyl-CCNU), Streptozocin, Suramin, Tamoxifen citrate, Taxane Analog, Temozolomide, Teniposide (VM-26), Thioguanine, Thiotepa, Topotecan, Tyrosine Kinase, UFT (Tegafur/Uracil), Valrubicin, Vinblastine sulfate, Vindesine sulfate, VX-710, VX-853, YM 116, ZD 0101, ZD 0473/Anormed, ZD 1839, ZD 9331.

Immuno-Oncology and Cell Therapies

Recent progress in the field of cancer immunology has allowed the development of several approaches to help the immune system keep the cancer at bay. Such immunotherapy approaches include the targeting of cancer antigens through monoclonal antibodies or through adoptive transfer of ex vivo engineered T cells (e.g., which contain chimeric antigen receptors or engineered T cell receptors).

In some embodiments, pharmaceutical compositions, CA2 biocircuits, CA2 biocircuit components, CA2 effector modules including their SREs or payloads of the present disclosure may be used in the modulation or alteration or exploitation of the immune system to target one or more cancers. This approach may also be considered with other such biological approaches, e.g., immune response modifying therapies such as the administration of interferons, interleukins, colony-stimulating factors, other monoclonal antibodies, vaccines, gene therapy, and nonspecific immunomodulating agents are also envisioned as anti-cancer therapies to be combined with the pharmaceutical compositions, CA2 biocircuits, CA2 biocircuit components, CA2 effector modules including their SREs or payloads of the present disclosure.

Cancer immunotherapy refers to a diverse set of therapeutic strategies designed to induce the patient's own immune system to fight the cancer. In some embodiments, pharmaceutical compositions, CA2 biocircuits, CA2 biocircuit components, CA2 effector modules including their SREs or payloads of the present disclosure are designed as immuno-oncology therapeutics.

Cell Therapies

There are several types of cellular immunotherapies, including tumor infiltrating lymphocyte (TIL) therapy, genetically engineered T cells bearing chimeric antigen receptors (CARs), and recombinant TCR technology.

According to the present disclosure, the CA2 biocircuits and systems may be used in the development and implementation of cell therapies such as adoptive cell therapy. Certain effector modules useful in cell therapy are given in FIGS. 8-13 of the International Publication WO2017/180587 (the contents each of which are herein incorporated by reference in their entirety). The CA2 biocircuits, CA2 effector modules and their SREs and payloads may be used in cell therapies to effect TCR removal-TCR gene disruption, TCR engineering, to regulate epitope tagged receptors, in APC platforms for stimulating T cells, as a tool to enhance ex vivo APC stimulation, to improve methods of T cell expansion, in ex vivo stimulation with antigen, in TCR/CAR combinations, in the manipulation or regulation of TILs, in allogeneic cell therapy, in combination T cell therapy with other treatment lines (e.g. radiation, cytokines), to encode engineered TCRs, or modified TCRs, or to enhance T cells other than TCRs (e.g. by introducing cytokine genes, genes for the checkpoint inhibitors PD1, CTLA4).

In some embodiments, improved response rates are obtained in support of cell therapies.

Expansion and persistence of cell populations may be achieved through regulation or fine tuning of the payloads, e.g., the receptors or pathway components in T cells, NK cells or other immune-related cells. In some embodiments, CA2 biocircuits, their components, SREs or CA2 effector modules are designed to spatially and/or temporally control the expression of proteins which enhance T-cell or NK cell response. In some embodiments, CA2 biocircuits, SREs or CA2 effector modules are designed to spatially and/or temporally control the expression of proteins which inhibit T-cell or NK cell response.

In some embodiments, CA2 biocircuits, SREs or CA2 effector modules are designed to reshape the tumor microenvironment to extend utility of the biocircuit or a pharmaceutical composition beyond direct cell killing.

In some embodiments, CA2 biocircuits, SREs or CA2 effector modules are designed to reduce, mitigate or eliminate the CAR cytokine storm. In some embodiments, such reduction, mitigation and/or elimination occurs in solid tumors or tumor microenvironments.

In some embodiments, the CA2 effector modules may encode one or more cytokines.

In one embodiment, the payload of the present disclosure may comprise IL2. In one embodiment, the CA2 effector module of the present disclosure may be CA2 DD-IL2 fusion polypeptide.

In one aspect, the CA2 effector module of the present disclosure may be a CA2 DD-mbIL12 fusion polypeptide. Regulatable DD-mbIL12 fusion polypeptide may be directly used as an immunotherapeutic agent or be transduced into an effector immune cell (T cells and TIL cells) to generate modified T cells with greater in vivo expansion and survival capabilities for adoptive cell transfer. The need for harsh preconditioning regimens in current adoptive cell therapies may be minimized using regulated CA2 DD-mbIL12 may be utilized to modify tumor microenvironment and increase persistence in solid tumors that are currently refractory to tumor antigen targeted therapy. In some embodiments, CAR expressing T cells may be armored with DD regulated mbIL12 to relieve immunosuppression without systemic toxicity.

In some embodiments, the IL12 may be a Flexi IL12, wherein both p35 and p40 subunits, are encoded by a single cDNA that produces a single chain polypeptide. In some embodiments, the IL12 may be a mbIL12, wherein p35 and p40 subunits, are separated by a linker and the mbIL12 further comprises a transmembrane domain, which are all encoded by a single polynucleotide that produces a single chain polypeptide.

The immune system can be harnessed for the treatment of diseases beyond cancer. CA2 biocircuits, their components, SREs or CA2 effector modules may be utilized in immunotherapy for the treatment of diseases including, but not limited to, autoimmune diseases, allergies, graft versus host disease, and diseases and disorders that may result in immunodeficiency such as acquired immune deficiency syndrome (AIDS).

In some embodiments, payloads of the present disclosure may be a chimeric antigen receptor (CAR), which when transduced into immune cells (e.g., T cells and NK cells), can re-direct the immune cells against the target (e.g., a tumor cell) which expresses a molecule recognized by the extracellular target moiety of the CAR.

As used herein, the term "chimeric antigen receptor (CAR)" refers to a synthetic receptor that mimics the TCR on the surface of T cells. In general, a CAR is composed of an extracellular targeting domain, a transmembrane domain/region and an intracellular signaling/activation domain. In a standard CAR receptor, the components: the extracellular targeting domain, transmembrane domain and intracellular signaling/activation domain, are linearly constructed as a single fusion protein. The extracellular region comprises a targeting domain/moiety (e.g., a scFv) that recognizes a specific tumor antigen or other tumor cell-surface molecules. The intracellular region may contain a signaling domain of TCR complex (e.g., the signal region of CD3Q, and/or one or more costimulatory signaling domains, such as those from CD28, 4-1BB (CD137) and OX-40 (CD134). For example, a "first-generation CAR" only has the CD3ζ signaling domain, whereas a second-generation CARs has a CD3ζ signal domain plus one costimulatory signaling domain, and a third-generation CARs having CD3ζ signal domain plus two or more costimulatory signaling domains. A CAR, when expressed by a T cell, endows the T cell with antigen specificity determined by the extracellular targeting moiety of the CAR. It is also desirable to add one or more elements such as homing and suicide genes to develop a more competent and safer architecture of CAR, which has given rise to the so called the fourth-generation CAR.

In some embodiments, the extracellular targeting domain is joined through the hinge (also called space domain or spacer) and transmembrane regions to an intracellular signaling domain. The hinge may need to be varied to optimize the potency of CAR expressing cells towards the cancer cells due to the size of the target protein where the targeting moiety binds, and the size and affinity of the targeting domain itself. Upon recognition and binding of the targeting moiety to the target cell, the intracellular signaling domain leads to an activation signal for the CAR T cell, which is further amplified by the "second signal" from one or more intracellular costimulatory domains. The CAR T cell, once activated, can destroy the target cell.

According to the present disclosure, the payload of the present disclosure may be a first-generation CAR, or a second-generation CAR, or a third-generation CAR, or a fourth-generation CAR. Representative effector module embodiments comprising CAR constructs are illustrated in FIG. 13-18 of International Publication No. WO2017/180587 (the contents of which are herein incorporated by reference in their entirety).

In accordance with the present disclosure, the extracellular target moiety of a CAR may be any agent that recognizes and binds to a given target molecule, for example, a neoantigen on tumor cells, with high specificity and affinity. The target moiety may be an antibody and variants thereof that specifically bind to a target molecule on tumor cells, or a peptide aptamer selected from a random sequence pool based on its ability to bind to the target molecule on tumor cells, or a variant or fragment thereof that can bind to the target molecule on tumor cells, or an antigen recognition domain from native T-cell receptor (TCR) (e.g. CD4 extracellular domain to recognize HIV infected cells), or exotic recognition components such as a linked cytokine that leads to recognition of target cells bearing the cytokine receptor, or a natural ligand of a receptor.

In some embodiments, the targeting moiety of a CAR construct may be a natural ligand of the target molecule, or a variant and/or fragment thereof capable of binding the target molecule. In some aspects, the targeting moiety of a CAR may be a receptor of the target molecule.

In some embodiments, the targeting moiety of a CAR may recognize a tumor specific antigen (TSA), for example a cancer neoantigen whose expression is restricted to tumor cells.

As non-limiting examples, the CAR of the present disclosure may comprise the extracellular targeting domain capable of binding to a tumor specific antigen selected from 5T4, 707-AP, A33, AFP (α-fetoprotein), AKAP-4 (A kinase anchor protein 4), ALK, α5β1-integrin, androgen receptor, annexin II, alpha-actinin-4, ART-4, B1, B7H3, B7H4, BAGE (B melanoma antigen), BCMA, BCR-ABL fusion protein, beta-catenin, BKT-antigen, BTAA, CA-I (carbonic anhydrase I), CA50 (cancer antigen 50), CA125, CA15-3, CA195, CA242, calretinin, CAIX (carbonic anhydrase), CAMEL (cytotoxic T-lymphocyte recognized antigen on melanoma), CAM43, CAP-1, Caspase-8/m, CD4, CD5, CD7, CD19, CD20, CD22, CD23, CD25, -CD27, CD27/m, CD28, CD30, CD33, CD34, CD36, CD38, CD40/CD154, CD41, CD44v6, CD44v7/8, CD45, CD49f, CD56, CD68\KP1, CD74, CD79a/CD79b, CD103, CD123, CD133, CD138, CD171, cdc27/m, CDK4 (cyclin dependent kinase 4), CDKN2A, CDS, CEA (carcinoembryonic antigen), CEACAM5, CEACAM6, chromogranin, c-Met, c-Myc, coa-1, CSAp, CT7, CT10, cyclophilin B, cyclin B1, cytoplasmic tyrosine kinases, cytokeratin, DAM-10, DAM-6, dek-can fusion protein, desmin, DEPDC1 (DEP domain containing 1), E2A-PRL, EBNA, EGF-R (epidermal growth factor receptor), EGP-1(epithelial glycoprotein-1) (TROP-2), EGP-2, EGP-40, EGFR (epidermal growth factor receptor), EGFRvIII, EF-2, ELF2M, EMMPRIN, EpCAM (epithelial cell adhesion molecule), EphA2, Epstein Barr virus antigens, Erb (ErbB1; ErbB3; ErbB4), ETA (epithelial tumor antigen), ETV6-AML1 fusion protein, FAP (fibroblast activation protein), FBP (folate-binding protein), FGF-5, folate receptor a, FOS related antigen 1, fucosyl GM1, G250, GAGE (GAGE-1; GAGE-2), galactin, GD2 (ganglioside), GD3, GFAP (glial fibrillary acidic protein), GM2 (oncofetal antigen-immunogenic-1; OFA-I-1), GnT-V, Gp100, H4-RET, HAGE (helicase antigen), HER-2/neu, HIFs (hypoxia inducible factors), HIF-1α, HIF-2α, HLA-A2, HLA-A*0201-R170I, HLA-A11, HMWMAA, Hom/Mel-40, HSP70-2M (Heat shock protein 70), HST-2, HTgp-175, hTERT (or hTRT), human papillomavirus-E6/human papillomavirus-E7 and E6, iCE (immune-capture EIA), IGF-1R, IGH-IGK, IL2R, IL5, ILK (integrin-linked kinase), IMP3 (insulin-like growth factor II mRNA-binding protein 3), IRF4 (interferon regulatory factor 4), KDR (kinase insert domain receptor), KIAA0205, KRAB-zinc finger protein (KID)-3; KID31, KSA (17-1A), K-ras, LAGE, LCK, LDLR/FUT (LDLR-fucosyltransferaseAS fusion protein), LeY (Lewis Y), MAD-CT-1, MAGE (tyrosinase, melanoma-associated antigen) (MAGE-1; MAGE-3), melan-A tumor antigen (MART), MART-2/Ski, MC1R (melanocortin 1 receptor), MDM2, mesothelin, MPHOSPH1, MSA (muscle-specific actin), mTOR (mammalian targets of rapamycin), MUC-1, MUC-2, MUM-1 (melanoma associated antigen (mutated) 1), MUM-2, MUM-3, Myosin/m, MYL-RAR, NA88-A, N-acetylglucosaminyltransferase, neo-PAP, NF-KB (nuclear factor-kappa B), neurofilament, NSE (neuron-specific enolase), Notch receptors, NuMa, N-Ras, NY-BR-1, NY-CO-1, NY-ESO-1, Oncostatin M, OS-9, OY-TES1, p53 mutants, p190 minor bcr-abl, pl5(58), pl85erbB2, pl80erbB-3, PAGE (prostate associated gene), PAP (prostatic acid phosphatase), PAX3, PAX5, PDGFR (platelet derived growth factor receptor), cytochrome P450 involved in piperidine and pyrrolidine utilization (PIPA), Pm1-RAR alpha fusion protein, PR-3 (proteinase 3), PSA (prostate specific antigen), PSM, PSMA (Prostate stem cell antigen), PRAME (preferentially expressed antigen of melanoma), PTPRK, RAGE (renal tumor antigen), Raf (A-Raf, B-Raf and C-Raf), Ras, receptor tyrosine kinases, RCAS1, RGSS, ROR1 (receptor tyrosine kinase-like orphan receptor 1), RU1, RU2, SAGE, SART-1, SART-3, SCP-1, SDCCAG16, SP-17 (sperm protein 17), src-family, SSX (synovial sarcoma X breakpoint)-1, SSX-2(HOM-MEL-40), SSX-3, SSX-4, SSX-5, STAT-3, STAT-5, STAT-6, STEAD, STn, survivin, syk-ZAP70, TA-90 (Mac-2 binding protein\cyclophilin C-associated protein), TAAL6, TACSTD1 (tumor associated calcium signal transducer 1), TACSTD2, TAG-72-4, TAGE, TARP (T cell receptor gamma alternate reading frame protein), TEL/AML1 fusion protein, TEM1, TEM8 (endosialin or CD248), TGFβ, TIE2, TLP, TMPRSS2 ETS fusion gene, TNF-receptor (TNF-α receptor, TNF-β receptor, or TNF-γ receptor), transferrin receptor, TPS, TRP-1 (tyrosine related protein 1), TRP-2, TRP-2/INT2, TSP-180, VEGF receptor, WNT, WT-1 (Wilm's tumor antigen) and XAGE.

As non-limiting examples, the targeting moiety of the present disclosure may be a scFv antibody that recognizes a tumor specific antigen (TSA), for example scFvs of antibodies SS, SS1 and HN1 that specifically recognize and bind to human mesothelin (U.S. Pat. No. 9,359,447), scFv of antibody of GD2 (U.S. Pat. No. 9,315,585), a CD19 antigen binding domain (U.S. Pat. No. 9,328,156); a NKG2D ligand binding domain (U.S. Pat. No. 9,273,283; US patent publication NO.: US20160311906A1); human anti-mesothelin scFvs comprising the amino acid sequences of SEQ ID NO.: 11 and 12 of U.S. Pat. No. 9,272,002; an anti-CS1 binding agent (US patent publication NO.: US20160075784); an anti-BCMA binding domain (International Patent Publication NO.: WO2016/014565); anti-CD19 scFv antibody of SEQ ID NO.: 20 in U.S. Pat. No. 9,102,761; GFR alpha 4 antigen binding fragments having the amino acid sequences of SEQ ID NOs.: 59 and 79 of International patent publication NO.: 2016/025880; anti-CLL-1 (C-type lectin-like molecule 1) binding domains having the amino acid sequences of SEQ ID NO.:47, 44, 48, 49, 50, 39, 40, 41, 42, 43, 45, 46, 51, 73, 70, 74, 75, 76, 65, 66, 67, 68, 69, 71, 72, 77, 195, 86, 83, 87, 88, 89, 78, 79, 80, 81, 82, 84, 85, 90 and 1% of International Patent Publication NO.: WO2016014535); CD33 binding domains having the amino acid sequences of SEQ ID NOs.: 39-46 of International patent publication NO.: WO2016014576; a GPC3 (glypican-3) binding domain (SEQ ID NO.: 2 and SEQ ID NO.: 4 of International patent publication NO.: WO2016036973); a GFR alpha4 (Glycosyl-phosphatidylinositol (GPI)-linked GDNF family α-receptor 4 cell-surface receptor) binding domain (International Patent Publication NO.: WO2016025880); CD123 binding domains having the amino acid sequences of SEQ ID NOs.: 480, 483, 485, 478, 158, 159, 160, 157, 217, 218, 219, 216, 276, 277, 278, and 275 of International patent publication NO.: WO201602588%; an anti-ROR1 antibody or fragments thereof (International patent publication NO.: WO2016016344); scFvs specific to GPC-3 (SEQ ID NOs.: 1 and 24 of International patent publication NO.: WO2016049459); scFv for CSPG4 (SEQ ID NO.: 2 of International patent publication NO.: WO2015080981; scFv for folate receptor alpha (US Patent Publication No.: US20170002072A1); the contents of each of which are incorporated herein by reference in their entirety.

The intracellular domain of a CAR fusion polypeptide, after binding to its target molecule, transmits a signal to the effector immune cell, activating at least one of the normal effector functions of effector immune cells, including cytolytic activity (e.g., cytokine secretion) or helper activity. Therefore, the intracellular domain comprises an "intracellular signaling domain" of a T cell receptor (TCR). In some embodiments, the intracellular signaling domain of the present disclosure may contain signaling motifs which are known as immunoreceptor tyrosine-based activation motifs (ITAMs). In some embodiments, the intracellular region of the present disclosure further comprises one or more costimulatory signaling domains which provide additional signals to the effector immune cells. These costimulatory signaling domains, in combination with the signaling domain can further improve expansion, activation, memory, persistence, and tumor-eradicating efficiency of CAR engineered immune cells (e.g., CAR T cells). In some cases, the costimulatory signaling region contains 1, 2, 3, or 4 cytoplasmic domains of one or more intracellular signaling and for costimulatory molecules.

In one embodiment of the present disclosure, the CAR of the present disclosure is a CD19 specific CAR. In the context of the present disclosure, a CA2 effector module may comprise an CA2 DD operably linked to a CD19 CAR fusion construct.

In some embodiments, pharmaceutical compositions, CA2 biocircuits, CA2 biocircuit components, CA2 effector modules including their SREs or payloads of the present disclosure may be used in the modulation or alteration or exploitation of the immune system to target one or more self-reactive immune components such as auto antibodies and self-reactive immune cells to attenuate autoimmune diseases. In some embodiments, the SREs of the present disclosure may be utilized in regulating or tuning the Chimeric Auto Antibody Receptor (CAAR) based T cell therapy in order to optimize its utility in the treatment of autoimmune diseases (Ellebrecht C. T. et al., Science. 2016. Jul. 8; 353(6295):179-84; the contents of which are incorporated herein by reference in their entirety). In some embodiments, CA2 biocircuits, SREs or CA2 effector modules are designed to modulate Tregs to attenuate autoimmune disorders. In such a case, mbIL2 may be regulated using a singly tuned module or one having multiple tuned features as described herein.

In some embodiments, CA2 biocircuits, SREs or CA2 effector modules may be utilized in immunotherapy-based treatments to attenuate or mitigate Graft vs. Host disease (GVHD). GVHD refers to a condition following stem cell or bone marrow transplant where in the allogeneic donor immune cells react against host tissue. In some embodiments, CA2 biocircuits, SREs or CA2 effector modules are designed to modulate Tregs for the treatment of GVHD. In one embodiment, CA2 biocircuits containing a CA2 effector module encoding TNF-alpha may be used to modulate Tregs to minimize GVHD (Pierini, A. et al., Blood. 2016. Aug. 11; 128(6):866-71; the contents of which are incorporated herein by reference in their entirety).

In some embodiments, CA2 biocircuits, SREs or CA2 effector modules are designed to be significantly less immunogenic than other biocircuits or switches in the art.

As used herein, "significantly less immunogenic" refers to a detectable decrease in immunogenicity. In another embodiment, the term refers to a fold decrease in immunogenicity. In another embodiment, the term refers to a decrease such that an effective amount of the CA2 biocircuits, SREs or CA2 effector modules which can be administered without triggering a detectable immune response. In another embodiment, the term refers to a decrease such that the CA2 biocircuits, SREs or CA2 effector modules can be repeatedly administered without eliciting an immune response. In another embodiment, the decrease is such that the CA2 biocircuits, SREs or CA2 effector modules can be repeatedly administered without eliciting an immune response.

In another embodiment, the CA2 biocircuits, SREs or CA2 effector modules is 2-fold less immunogenic than its unmodified counterpart or reference compound. In another embodiment, immunogenicity is reduced by a 3-fold factor. In another embodiment, immunogenicity is reduced by a 5-fold factor. In another embodiment, immunogenicity is reduced by a 7-fold factor. In another embodiment, immunogenicity is reduced by a 10-fold factor. In another embodiment, immunogenicity is reduced by a 15-fold factor. In another embodiment, immunogenicity is reduced by a fold factor. In another embodiment, immunogenicity is reduced by a 50-fold factor. In another embodiment, immunogenicity is reduced by a 100-fold factor. In another embodiment, immunogenicity is reduced by a 200-fold factor. In another embodiment, immunogenicity is reduced by a 500-fold factor. In another embodiment, immunogenicity is reduced by a 1000-fold factor. In another embodiment, immunogenicity is reduced by a 2000-fold factor. In another embodiment, immunogenicity is reduced by another fold difference.

Methods of determining immunogenicity are well known in the art, and include, e.g. measuring secretion of cytokines (e.g. IL12, IFN alpha, TNF-alpha, RANTES, MIP-1alpha or beta, IL6, IFN-beta, or IL8), measuring expression of DC activation markers (e.g. CD83, HLA-DR, CD80 and CD86), or measuring ability to act as an adjuvant for an adaptive immune response.

Diseases and Toxins

Various infectious diseases may be treated with pharmaceutical compositions, CA2 biocircuits, CA2 biocircuit components, CA2 effector modules including their SREs or payloads of the present disclosure. As used herein, the term "infectious disease" refers to any disorders caused by organisms such as bacteria, viruses, fungi or parasites.

Various toxins may be treated with pharmaceutical compositions, CA2 biocircuits, CA2 biocircuit components, CA2 effector modules including their SREs or payloads of the present disclosure. Non-limited examples of toxins include Ricin, *Bacillus anthracis*, Shiga toxin and Shiga-like toxin, Botulinum toxins.

Various tropical diseases may be treated with pharmaceutical compositions, CA2 biocircuits, CA2 biocircuit components, CA2 effector modules including their SREs or payloads of the present disclosure. Non-limited examples of tropical diseases include Chikungunya fever, Dengue fever, Chagas disease, Rabies, Malaria, Ebola virus, Marburg virus, West Nile Virus, Yellow Fever, Japanese encephalitis virus, St. Louis encephalitis virus.

Various foodborne illnesses and gastroenteritis may be treated with pharmaceutical compositions, CA2 biocircuits, CA2 biocircuit components, CA2 effector modules including their SREs or payloads of the present disclosure. Non-limited examples of foodborne illnesses and gastroenteritis include Rotavirus, Norwalk virus (Norovirus), *Campylobacter jejuni*, *Clostridium difficile*, *Entamoeba histolytica*, *Helicobacter pylori*, Enterotoxin B of *Staphylococcus aureus*, Hepatitis A virus (HAV), Hepatitis E, *Listeria monocytogenes*, *Salmonella*, *Clostridium perfringens*, and *Salmonella*.

Various infectious agents may be treated with pharmaceutical compositions, CA2 biocircuits, CA2 biocircuit components, CA2 effector modules including their SREs or payloads of the present disclosure. Non-limited examples of infectious agents include adenoviruses, *Anaplasma phagocytophilium*, *Ascaris lumbricoides*, *Bacillus anthracis*, *Bacillus cereus*, *Bacteroides* sp, Barmah Forest virus, *Bartonella bacilliformis*, *Bartonella henselae*, *Bartonella quintana*, beta-toxin of *Clostridium perfringens*, *Bordetella pertussis*, *Bordetella parapertussis*, *Borrelia burgdorferi*, *Borrelia miyamotoi*, *Borrelia recurrentis*, *Borrelia* sp., Botulinum toxin, *Brucella* sp., *Burkholderia pseudomallei*, California encephalitis virus, *Campylobacter*, *Candida albicans*, chikungunya virus, *Chlamydia psittaci*, *Chlamydia trachomatis*, *Clonorchis sinensis*, *Clostridium difficile* bacteria, *Clostridium tetani*, Colorado tick fever virus, *Corynebacterium diphtheriae*, *Corynebacterium minutissimum*, *Coxiella burnetii*, coxsackie A, coxsackie B, Crimean-Congo hemorrhagic fever virus, cytomegalovirus, dengue virus, Eastern Equine encephalitis virus, Ebola viruses, echovirus, *Ehrlichia chaffeensis.*, *Ehrlichia* equi., *Ehrlichia* sp., *Entamoeba histolytica*, *Enterobacter* sp., *Enterococcus faecalis*, Enterovirus 71, Epstein-Barr virus (EBV), *Erysipelothrix rhusiopathiae*, *Escherichia coli*, Flavivirus, *Fusobacterium necrophorum*, *Gardnerella vaginalis*, Group B streptococcus, *Haemophilus aegyptius*, *Haemophilus ducreyi*, *Haemophilus influenzae*, hantavirus, *Helicobacter pylori*, Hepatitis A, Hepatitis B, Hepatitis C, Hepatitis D, Hepatitis E, herpes simplex virus 1 and 2, human herpes virus 6, human herpes Virus 8, human immunodeficiency virus 1 and 2, human T-cell leukemia viruses I and II, influenza viruses (A, B, C), Jamestown Canyon virus, Japanese encephalitis antigenic, Japanese encephalitis virus, John Cunninham virus, juninvirus, Kaposi's Sarcoma-associated Herpes Virus (KSHV), *Klebsiella granulomatis, Klebsiella* sp., *Kyasanur* Forest Disease virus, La Crosse virus, Lassavirus, *Legionella pneumophila, Leptospira interrogans, Listeria monocytogenes*, lymphocytic choriomeningitis virus, lyssavirus, Machupovirus, Marburg virus, measles virus, MERS coronavirus (MERS-CoV), *Micrococcus sedentarius, Mobiluncus* sp., Molluscipoxvirus, *Moraxella catarrhalis*, Morbilli-Rubeola virus, Mumpsvirus, *Mycobacterium leprae, Mycobacterium tuberculosis, Mycobacterium ulcerans*, Mycoplasmagenitalium, *Mycoplasma* sp, Nairovirus, *Neisseria gonorrhoeae, Neisseria meningitidis, Nocardia*, Norwalk virus, norovirus, Omsk hemorrhagic fever virus, papilloma virus, parainfluenza viruses 1-3, parapoxvirus, parvovirus B19, *Peptostreptococcus* sp., *Plasmodium* sp., polioviruses types I, II, and III, *Proteus* sp., *Pseudomonas aeruginosa, Pseudomonas pseudomallei, Pseudomonas* sp., rabies virus, respiratory syncytial virus, ricin toxin, *Rickettsia australis, Rickettsia conori, Rickettsia honei, Rickettsia prowazekii*, Ross River Virus, rotavirus, rubellavirus, Saint Louis encephalitis, *Salmonella Typhi, Sarcoptes scabiei*, SARS-associated coronavirus (SARS-CoV), *Serratia* sp., Shiga toxin and Shiga-like toxin, *Shigella* sp., Sin Nombre Virus, Snowshoe hare virus, *Staphylococcus aureus, Staphylococcus epidermidis, Streptobacillus monilformis, Streptococcus pneumoniae, Streptococcus agalactiae, Streptococcus agalactiae, Streptococcus* group A-H, *Streptococcus pneumoniae, Streptococcus pjogenes, Treponema pallidum* subsp. *Pallidum, Treponema pallidum* var. *carateum, Treponema pallidum* var. *endemicum, Tropheryma whippelii, Ureaplasma urealyticum*, Varicella-Zoster virus, variola virus, *Vibrio cholerae*, West Nile virus, yellow fever virus, *Yersinia enterocolitica, Yersinia pestis*, and Zika virus.

Various rare diseases may be treated with pharmaceutical compositions, CA2 biocircuits, CA2 biocircuit components, CA2 effector modules including their SREs or payloads of the present disclosure. As used herein, the term "rare disease" refers to any disease that affects a small percentage of the population.

Various autoimmune diseases and autoimmune-related diseases may be treated with pharmaceutical compositions, CA2 biocircuits, CA2 biocircuit components, CA2 effector modules including their SREs or payloads of the present disclosure. As used herein, the term "autoimmune disease" refers to a disease in which the body produces antibodies that attack its own tissues. As a non-limiting example, the autoimmune disease may be Acute Disseminated Encephalomyelitis (ADEM), Acute necrotizing hemorrhagic leukoencephalitis, Addison's disease, Agammaglobulinemia, Alopecia areata, Amyloidosis, Ankylosing spondylitis, Anti-GBM/Anti-TBM nephritis, Antiphospholipid syndrome (APS), Autoimmune angioedema, Autoimmune aplastic anemia, Autoimmune dysautonomia, Autoimmune hepatitis, Autoimmune hyperlipidemia, Autoimmune immunodeficiency, Autoimmune inner ear disease (AIED), Autoimmune myocarditis, Autoimmune oophoritis, Autoimmune pancreatitis, Autoimmune retinopathy, Autoimmune thrombocytopenic purpura (ATP), Autoimmune thyroid disease, Autoimmune urticaria, Axonal & neuronal neuropathies, Balo disease, Behcet's disease, Bullous pemphigoid, Cardiomyopathy, Castleman disease, Celiac disease, Chagas disease, Chronic fatigue syndrome, Chronic inflammatory demyelinating polyneuropathy (CIDP), Chronic recurrent multifocal ostomyelitis (CRMO), Churg-Strauss syndrome, Cicatricial pemphigoid/benign mucosal pemphigoid, Crohn's disease, Cogans syndrome, Cold agglutinin disease, Congenital heart block, Coxsackie myocarditis, CREST disease, Essential mixed cryoglobulinemia, Demyelinating neuropathies, Dermatitis herpetiformis, Dermatomyositis, Devic's disease (neuromyelitis optica), Discoid lupus, Dressler's syndrome, Endometriosis, Eosinophilic esophagitis, Eosinophilic fasciitis, Erythema nodosum, Experimental allergic encephalomyelitis, Evans syndrome, Fibromyalgia, Fibrosing alveolitis, Giant cell arteritis (temporal arteritis), Giant cell myocarditis, Glomerulonephritis, Goodpasture's syndrome, Granulomatosis with Polyangiitis (GPA) (formerly called Wegener's Granulomatosis), Graves' disease, Guillain-Barre syndrome, Hashimoto's encephalitis, Hashimoto's thyroiditis, Hemolytic anemia, Henoch-Schonlein purpura, Herpes gestationis, Hypogammaglobulinemia, Idiopathic thrombocytopenic purpura (ITP), IgA nephropathy, IgG4-related sclerosing disease, Immunoregulatory lipoproteins, Inclusion body myositis, Interstitial cystitis, Juvenile arthritis, Juvenile diabetes (Type 1 diabetes), Juvenile myositis, Kawasaki syndrome, Lambert-Eaton syndrome, Leukocytoclastic vasculitis, Lichen planus, Lichen sclerosis, Ligneous conjunctivitis, Linear IgA disease (LAD), Lupus (SLE), Lyme disease, chronic, Meniere's disease, Microscopic polyangiitis, Mixed connective tissue disease (MCTD), Mooren's ulcer, Mucha-Habermann disease, Multiple sclerosis, Myasthenia gravis, Myositis, Narcolepsy, Neuromyelitis optica (Devic's), Neutropenia, Ocular cicatricial pemphigoid, Optic neuritis, Palindromic rheumatism, PANDAS (Pediatric Autoimmune Neuropsychiatric Disorders Associated with *Streptococcus*), Paraneoplastic cerebellar degeneration, Paroxysmal nocturnal hemoglobinuria (PNH), Parry Romberg syndrome, Parsonnage-Turner syndrome, Pars planitis (peripheral uveitis), Pemphigus, Peripheral neuropathy, Perivenous encephalomyelitis, Pernicious anemia, POEMS syndrome, Polyarteritis nodosa, Type I, II, & III autoimmune polyglandular syndromes, Polymyalgia rheumatica, Polymyositis, Postmyocardial infarction syndrome, Postpericardiotomy syndrome, Progesterone dermatitis, Primary biliary cirrhosis, Primary sclerosing cholangitis, Psoriasis, Psoriatic arthritis, Idiopathic pulmonary fibrosis, Pyoderma gangrenosum, Pure red cell aplasia, Raynauds phenomenon, Reactive Arthritis, Reflex sympathetic dystrophy, Reiter's syndrome, Relapsing polychondritis, Restless legs syndrome, Retroperitoneal fibrosis, Rheumatic fever, Rheumatoid arthritis, Sarcoidosis, Schmidt syndrome, Scleritis, Scleroderma, Sjogren's syndrome, Sperm & testicular autoimmunity, Stiff person syndrome, Subacute bacterial endocarditis (SBE), Susac's syndrome, Sympathetic ophthalmia, Takayasu's arteritis, Temporal arteritis/Giant cell arteritis, Thrombocytopenic purpura (TTP), Tolosa-Hunt syndrome, Transverse myelitis, Ulcerative colitis, Undifferentiated connective tissue disease (UCTD), Uveitis, Vasculitis, Vesiculobullous dermatosis, Vitiligo, and Wegener's granulomatosis (now termed Granulomatosis with Polyangiitis (GPA).

Various kidney diseases may be treated with pharmaceutical compositions, CA2 biocircuits, CA2 biocircuit components, CA2 effector modules including their SREs or payloads of the present disclosure.

Various cardiovascular diseases may be treated with pharmaceutical compositions, CA2 biocircuits, CA2 biocircuit components, CA2 effector modules including their SREs or payloads of the present disclosure. As a non-limiting example, the cardiovascular disease may be Ischemic heart disease also known as coronary artery disease, Cerebrovascular disease (Stroke), Peripheral vascular disease, Heart failure, Rheumatic heart disease, and Congenital heart disease.

Various antibody deficiencies may be treated with pharmaceutical compositions, CA2 biocircuits, CA2 biocircuit components, CA2 effector modules including their SREs or payloads of the present disclosure. As a non-limiting example, the antibody deficiencies may be X-Linked Agammaglobulinemia (XLA), Autosomal Recessive Agammaglobulinemia (ARA), Common Variable Immune Deficiency (CVID), IgG (IgG1, IgG2, IgG3 and IgG4) Subclass Deficiency, Selective IgA Deficiency, Specific Antibody Deficiency (SAD), Transient Hypogammaglobulinemia of Infancy, Antibody Deficiency with Normal or Elevated Immunoglobulins, Selective IgM Deficiency, Immunodeficiency with Thymoma (Good's Syndrome), Transcobalamin II Deficiency, Warts, Hypogammaglobulinemia, Infection, Myelokathexis (WHIM) Syndrome, Drug-Induced Antibody Deficiency, Kappa Chain Deficiency, Heavy Chain Deficiencies, Post-Meiotic Segregation (PMS2) Disorder, and Unspecified Hypogammaglobulinemia.

Various ocular diseases may be treated with pharmaceutical compositions, CA2 biocircuits, CA2 biocircuit components, CA2 effector modules including their SREs or payloads of the present disclosure. As a non-limiting example, the ocular disease may be thyroid eye disease (TED), Graves' disease (GD) and orbitopathy, Retina Degeneration, Cataract, optic atrophy, macular degeneration, Leber congenital amaurosis, retinal degeneration, cone-rod dystrophy, Usher syndrome, leopard syndrome, photophobia, and photoaversion.

Various neurological diseases may be treated with pharmaceutical compositions, CA2 biocircuits, CA2 biocircuit components, CA2 effector modules including their SREs or payloads of the present disclosure;

Various psychological disorders may be treated with pharmaceutical compositions, CA2 biocircuits, CA2 biocircuit components, CA2 effector modules including their SREs or payloads of the present disclosure.

Various lung diseases may be treated with pharmaceutical compositions, CA2 biocircuits, CA2 biocircuit components, CA2 effector modules including their SREs or payloads of the present disclosure. As a non-limiting example, the lung diseases may be Asbestosis, Asthma, Bronchiectasis, Bronchitis, Chronic Cough, Chronic Obstructive Pulmonary Disease (COPD), Croup, Cystic Fibrosis, Hantavirus, Idiopathic Pulmonary Fibrosis, Pertussis, Pleurisy, Pneumonia, Pulmonary Embolism, Pulmonary Hypertension, Sarcoidosis, Sleep Apnea, Spirometry, Sudden Infant Death Syndrome (SIDS), Tuberculosis, Alagille Syndrome, Autoimmune Hepatitis, Biliary Atresia, Cirrhosis, ERCP (Endoscopic Retrograde Cholangiopancreatography), and Hemochromatosis. Nonalcoholic Steatohepatitis, Porphyria, Primary Biliary Cirrhosis, Primary Sclerosing Cholangitis.

Various bone diseases may be treated with pharmaceutical compositions, CA2 biocircuits, CA2 biocircuit components, CA2 effector modules including their SREs or payloads of the present disclosure. As a non-limiting example, the bone diseases may be osteoporosis, neurofibromatosis, osteogenesis imperfecta (OI), rickets, osteosarcoma, achondroplasia, fracture, osteomyelitis, Ewing tumor of bone, osteomalacia, hip dysplasia, Paget disease of bone, marble bone disease, osteochondroma, bone cancer, bone disease, osteochondrosis, osteoma, fibrous dysplasia, cleidocranial dysostosis, osteoclastoma, bone cyst, metabolic bone disease, melorheostosis, callus, Caffey syndrome, and mandibulofacial dysostosis.

Various blood diseases may be treated with pharmaceutical compositions, CA2 biocircuits, CA2 biocircuit components, CA2 effector modules including their SREs or payloads of the present disclosure. As a non-limiting example, the blood diseases may be Anemia and CKD (for health care professionals), Aplastic Anemia and Myelodysplastic Syndromes, Deep Vein Thrombosis, Hemochromatosis, Hemophilia, Henoch-Schönlein Purpura, Idiopathic Thrombocytopenic Purpura, Iron-Deficiency Anemia, Pernicious Anemia, Pulmonary Embolism, Sickle Cell Anemia, Sickle Cell Trait and Other Hemoglobinopathies, Thalassemia, Thrombotic Thrombocytopenic Purpura, and Von Willebrand Disease.

Central Nervous System (CNS)

In some embodiments, pharmaceutical compositions, CA2 biocircuits, CA2 biocircuit components, CA2 effector modules including their SREs or payloads of the present disclosure may be used in the modulation or alteration or exploitation of proteins in the central nervous system including cerebrospinal (CSF) proteins.

In some examples, pharmaceutical compositions, CA2 biocircuits, CA2 biocircuit components, CA2 effector modules including their SREs or payloads of the present disclosure may be used to provide tunable ERT (enzyme replacement therapy) products to the central nervous system. Many lysosomal storage diseases (LSD) involve the CNS symptoms, such as mental retardation, seizures, profound neurodegeneration, behavioral abnormalities, and psycho-motor defects. ERT for LSDs is one of the true success stories in modern molecular medicine. The successful application of ERT relies on controlled lysosomal proteins (e.g., enzymes) and delivery to CNS cells.

Metabolic Peptides and Hormones

In some embodiments, the CA2 biocircuits of the present disclosure and/or any of their components may be used to regulate peptides, natural or synthetic. Naturally occurring peptides may include but are not limited to, peptide hormones, natriuretic peptides, food peptides, and derivatives and precursors.

The CA2 biocircuits of the present disclosure and/or any of their components may also be utilized for pulsatile release of hormones or other peptide drugs.

Patient Stratification

In one embodiment, patients may also be stratified according to the immunogenic peptides presented by their immune cells and may be utilized as a parameter to determine suitable patient cohorts that may therapeutically benefit for the compositions of the present disclosure.

Transgenic Organisms

In some embodiments, the present disclosure provides transgenic organisms that expresses nucleic acids that encode polypeptides of the present disclosure. As used herein the term "transgenic organism" refers to any non-human entity that contains artificially transferred, exogenous genetic material. This approach provides the ability to temporally regulate payloads within defined cells, tissues or in the entire organism. Such methods may be useful in creating transgenic models for certain disease states, or for studying embryonic development.

Transgenic organisms described herein may include rodents, fish, reptiles, as well as invertebrates. In a preferred embodiment, such transgenic organisms may be selected from the rodent family including mouse, and rat.

Tunable Regulations

The CA2 biocircuits of the present disclosure and/or any of their components may also be utilized to regulate the expression of another CA2 effector module such as a recombinant construct comprising a POI. In some embodiments, the CA2 biocircuits and/or CA2 effector modules may comprise a protease (also called peptidase or proteinase). The tunable protease could cleave an inactive construct to an active construct when the two components are co-introduced into a cell, a tissue or an organism.

In other examples, the CA2 biocircuits and/or CA2 effector modules comprising a protease may also be utilized to regulate protein processing including cleavage of the initial protein product to produce a smaller active protein or peptide.

In some embodiments, the CA2 biocircuits of the present disclosure and/or any of their components may comprise any of factors that play a role in protein processing and modification. Protein post-translational modification may include, but are not limited to, addition of hydrophobic groups by an enzyme (e.g., myristoylation, palmitoylation, isoprenylation, prenylation, farnesylation, geranylgeranylation, glypiation, and glycosylphosphatidylinositol (GPI) anchor); attachment of cofactors for enhanced function (e.g., lipoylation, flavin, phosphopantetheinylation, and heme C); addition of small chemical groups (e.g., acylation, formylation, alkylation, phosphorylation, methylation, arginylation, polyglutamylation, polyglycylation, butyrylation, glycosylation, propionylation, S-glutathionylation, S-nitrosylation, S-sulfenylation, succinylation, sulfation, and acetylation); linkage of other proteins and/or peptides such as ISGylation, SUMOylation, ubiquitination, neddylation, and pupylation; chemical modification of amino acids; and structural changes.

Biofactories

The CA2 biocircuits of the present disclosure and/or any of their components may be utilized to regulate the levels of protein production in a biofactory. As used herein, the term "biofactory" refers to a cell, a tissue, an organ or an organism genetically modified or not, which can produce proteins with a number of applications including therapeutic purposes (inhibitors, enzymes, antibodies, antigens, etc.) or primary or secondary products of industrial interest. In some examples, the cell may be a prokaryotic cell, a eukaryotic cell, a mammalian cell, a plant cell, etc.

In some embodiments, the CA2 biocircuits of the present disclosure may be used to regulate medicament proteins produced in a target tissue, for example, the liver and the kidney. The liver is an organ that produces secreted proteins including major plasma proteins, factors in hemostasis and fibrinolysis, carrier proteins, hormones, prohormones and apolipoproteins, or a variety of short-lived metabolic peptides and enzymes which are usually tightly regulated, or other non-hepatic proteins. In the context, the liver fills a role of gene expression factory (biofactory), supplying a protein for treatment of a disease for example a metabolic disease.

In other embodiments, the CA2 biocircuits of the present disclosure may be used to regulate proteins for industrial processes.

Liver Targeting

The liver is an important organ that produces proteins and involves blood clotting and a number of metabolic functions. A variety of diseases can affect liver and targeting the liver for disease treatment has been a promising approach, especially liver-targeted gene therapy. The CA2 biocircuits of the present disclosure and/or any of their components may be utilized to regulate liver targeted gene therapy and gene transfer.

Proteins that can be targeted to the liver and constructed to the present CA2 biocircuits for regulation may include those in liver cancers such as hepatocellular carcinoma (HCC), Fibrolamellar HCC, Cholangiocarcinoma, Angiosarcoma and secondary liver cancer, inherited disorders caused by defective genes such as hemochromatosis, Wilson disease, tyrosinemia, alpha 1 antitrypsin deficiency, glycogen storage disease; metabolic disorders due to enzyme deficiency such as Gilbert's syndrome, lysosomal acid lipase deficiency (LALD) and Gaucher disease; autoimmune hepatitis; fatty liver diseases; and viral hepatitis (A, B and C). In some examples, the present CA2 biocircuits may be used to direct IL12 for hepatocellular carcinoma (HCC), and IL10 for diabetic neuropathy.

Microfluidics

In some embodiments, cells containing CA2 biocircuits of the present disclosure and/or any of their components may be utilized in microfluidics devices. As used herein a "microfluidics device" refers to the manipulation of picoliter to nanoliter-scale volumes of fluids within artificially fabricated microsystems. Microfluidic devices comprising CA2 biocircuits of the present disclosure may be utilized to study cell culture models, cellular microenvironment, cell secretions, chemotaxis, apoptosis, vascular function, neuron cell growth, embryonic development, single cell metabolomics, gene expression, drug research, cellular separation, stem cell biology, bioreactors, three-dimensional cell culture, and tissue engineering.

Tools and Agents for Making Therapeutics

Provided in the present disclosure are tools and agents that may be used in generating therapeutics such as, but not limited to, immunotherapeutics for reducing a tumor volume or burden in a subject in need. A considerable number of variables are involved in producing a therapeutic agent, such as structure of the payload, type of cells, method of gene transfers, method and time of ex vivo expansion, preconditioning and the amount and type of tumor burden in the subject. Such parameters may be optimized using tools and agents described herein.

Cell Lines

The present disclosure provides a mammalian cell that has been genetically modified with the compositions of the present disclosure. Suitable mammalian cells include primary cells and immortalized cell lines. Suitable mammalian cell lines include, but are not limited to Human embryonic kidney cell line 293, fibroblast cell line NIH 3T3, human colorectal carcinoma cell line HCT116, ovarian carcinoma cell line SKOV-3, immortalized T cell lines (e.g. Jurkat cells and SupT1 cells), lymphoma cell line Raji cells, NALM-6 cells, K562 cells, HeLa cells, PC12 cells, HL-60 cells, NK cell lines (e.g. NKL, NK92, NK %2, and YTS), and the like. In some instances, the cell is not an immortalized cell line, but instead a cell obtained from an individual and is herein referred to as a primary cell. For example, the cell is a T lymphocyte obtained from an individual. Other examples include, but are not limited to cytotoxic cells, stem cells, peripheral blood mononuclear cells or progenitor cells obtained from an individual.

Tracking SREs, Biocircuits and Cell Lines

In some embodiments, it may be desirable to track the compositions of the present disclosure or the cells modified by the compositions described herein. Tracking may be achieved by using payloads such as reporter moieties, which, as used herein, refers to any protein capable of creating a detectable signal, in response to an input. Examples include alkaline phosphatase, β-galactosidase, chloramphenicol acetyltransferase, β-glucuronidase, peroxidase, β-lactamase, catalytic antibodies, bioluminescent proteins e.g. luciferase, and fluorescent proteins such as Green fluorescent protein (GFP).

Reporter moieties may be used to monitor the response of the SREs upon addition of the ligand corresponding to the SRE. In other instances, reporter moieties may be used to track cell survival, persistence, cell growth, and/or localization in vitro, in vivo, or ex vivo.

In some embodiments, the preferred reporter moiety may be luciferase proteins.

Chaperones

In some embodiments, CA2 effector modules of the present disclosure may include one or more chaperones to regulate the expression of the payload. Chaperones useful in the present disclosure may be cellular chaperones or small molecules referred to as pharmacological chaperones. Cellular chaperones refer to a large group of unrelated protein families whose role is to stabilize unfolded client proteins, or to unfold client proteins for translocation across membranes or for degradation, and/or to assist in their correct folding and assembly. Chaperones also cooperate with other components of the proteostasis network such as the proteasome system and autophagy to promote protein clearance. Examples of molecular chaperone families include small heat shock proteins such as hsp25; Heat shock protein 60 family proteins such as cpn60 and GroEL; Heat shock protein 70 family proteins such as DnaK and BiP; Heat shock protein 90 family proteins; Heat shock protein 100 family proteins such as Clp; lectin chaperones such as calnexin and calreticulin; and folding chaperones such as Protein disulfide isomerases (PDI), peptidyl prolyl ci-trans isomerase (PPI) and ERp57. In some embodiments, the payload of the present disclosure may be a cellular chaperone. In the absence of a stimulus which stabilizes the SRE, the cellular chaperone may bind to the SRE and is therefore unavailable to interact with its client proteins. In the presence of the stimulus specific to the SRE, the SRE is stabilized and the chaperone is available to interact with client proteins. In some embodiments, payloads of the present disclosure may be appended to chaperones such that the stability or instability of the payload may be enhanced. In other embodiments, the SREs of the present disclosure may consist of one or more molecular chaperones.

Chaperones useful in the present disclosure may also include pharmacological chaperones which utilizes small molecules to facilitate the correct folding and stabilization of cellular proteins. Mutations in cellular proteins can result in protein misfolding and/or aggregation which ultimately results in their degradation. Pharmacological chaperones have been designed to bind to misfolded target proteins, facilitate their correct folding and thereby prevent their degradation. In some embodiments, SREs of the present disclosure may comprise one or more misfolded proteins and the stimulus specific to the SRE may include one or pharmacological chaperones such that the CA2 effector module is stabilized only in the presence of the pharmacological chaperone.

Animal Models

The utility and efficacy of the compositions of the present disclosure may be tested in in vivo animal models, preferably mouse models. Mouse models used may be syngeneic mouse models wherein mouse cells are modified with compositions of the present disclosure and tested in mice of the same genetic background. Examples include pMEL-1 and 4T1 mouse models. Alternatively, xenograft models where human cells such as tumor cells and immune cells are introduced into immunodeficient mice may also be utilized in such studies. Immunodeficient mice used may be CByJ.Cg-Foxn1nu/J, B6; 129S7-Rag1tm1Mom/J, B6.129S7-Rag1tm1Mom/J, B6. CB17-Prkdcscid/SzJ, NOD. 129S7(B6)-Rag1tm1Mom/J, NOD.Cg-Rag1tm1MomPrf1tm1Sdz/Sz, NOD.CB17-Prkdcscid/SzJ, NOD.Cg-PrkdcscidB2mtm1Unc/J, NOD-scid IL2Rgnull, Nude (nu) mice, SCID mice, NOD mice, RAG1/RAG2 mice, NOD-Scid mice, IL2rgnull mice, b2mnull mice, NOD-scid IL2r□null mice, NOD-scid-B2mnull mice, beige mouse, and HLA transgenic mice.

Cellular Assays

In some embodiments, the effectiveness of the compositions of the disclosure as immunotherapeutic agents may be evaluated using cellular assays. Levels of expression and/or identity of the compositions described herein may be determined according to any methods known in the art for identifying proteins and/or quantitating proteins levels. In some embodiments, such methods may include Western Blotting, flow cytometry, and immunoassays.

Provided herein are methods for functionally characterizing cells expressing SRE, CA2 biocircuits and compositions of the invention. In some embodiments, functional characterization is carried out in primary immune cells or immortalized immune cell lines and may be determined by expression of cell surface markers. Examples of cell surface markers for T cells include, but are not limited to, CD3, CD4, CD8, CD 14, CD20, CD11b, CD16, CD45 and HLA-DR, CD 69, CD28, CD44, IFNgamma. Markers for T cell exhaustion include PD1, TIM3, BTLA, CD160, 2B4, CD39, and LAG3. Examples of cell surface markers for antigen presenting cells include, but are not limited to, MHC class I, MHC Class II, CD40, CD45, B7-1, B7-2, IFN γ receptor and IL2 receptor, ICAM-1 and/or Fcγ receptor. Examples of cell surface markers for dendritic cells include, but are not limited to, MHC class I, MHC Class II, B7-2, CD18, CD29, CD31, CD43, CD44, CD45, CD54, CD58, CD83, CD86, CMRF44, CMRF-56, DCIR and/or Dectin-1 and the like; while in some cases also having the absence of CD2, CD3, CD4, CD8, CD14, CD15, CD16, CD 19, CD20, CD56, and/or CD57. Examples of cell surface markers for NK cells include, but are not limited to, CCL3, CCL4, CCL5, CCR4, CXCR4, CXCR3, NKG2D, CD71, CD69, CCR5, Phospho JAK/STAT, phospho ERK, phospho p38/MAPK, phospho AKT, phospho STAT3, Granulysin, Granzyme B, Granzyme K, IL10, IL22, IFNg, LAP, Perforin, and TNFa.

T Cell Exhaustion

In some embodiments, CA2 biocircuits, SREs or CA2 effector modules may be utilized to prevent T cell exhaustion. As used herein, "T cell exhaustion" refers to the stepwise and progressive loss of T cell function caused by chronic T cell activation. T cell exhaustion is a major factor limiting the efficacy of antiviral and antitumor immunotherapies. Exhausted T cells have low proliferative and cytokine producing capabilities concurrent with high rates of apoptosis and high surface expression of multiple inhibitory receptors. T cell activation leading to exhaustion may occur either in the presence or absence of the antigen.

Cells

In accordance with the present disclosure, cells genetically modified to express at least one CA2 biocircuit, SRE (e.g., CA2 DD), CA2 effector module and immunotherapeutic agent of the present disclosure, are provided. Cells of the present disclosure may include, without limitation, immune cells, stem cells and tumor cells. In some embodiments, immune cells are effector immune cells, including, but not limiting to, T cells such as CD8+ T cells and CD4+ T cells (e.g., Th1, Th2, Th17, Foxp3+ cells), memory T cells such as T memory stem cells, central T memory cells, and effector memory T cells, terminally differentiated effector T cells, natural killer (NK) cells, NK T cells, tumor infiltrating lymphocytes (TILs), cytotoxic T lymphocytes (CTLs), regulatory T cells (Tregs), and dendritic cells (DCs), other immune cells that can elicit an effector function, or the mixture thereof. T cells may be Tαβ cells and Tγδ cells. In some embodiments, stem cells may be from human embryonic stem cells, mesenchymal stem cells, and neural stem cells. In some embodiments, T cells may be depleted endogenous T cell receptors (See U.S. Pat. Nos. 9,273,283; 9,181,527; and 9,028,812; the contents of each of which are incorporated herein by reference in their entirety).

In some embodiments, cells of the present disclosure may be autologous, allogeneic, syngeneic, or xenogeneic in relation to a particular individual subject.

In some embodiments, cells of the present disclosure may be mammalian cells, particularly human cells. Cells described herein may be primary cells or immortalized cell lines.

In some embodiments, cells of the present disclosure may include expansion factors as payload to trigger proliferation and expansion of the cells. Exemplary payloads include members of the RAS superfamily.

Engineered immune cells can be accomplished by transducing a cell composition with a polypeptide of a CA2 biocircuit, a CA2 effector module, a SRE and/or a payload of interest (e.g., immunotherapeutic agent), or a polynucleotide encoding said polypeptide, or a vector comprising said polynucleotide. The vector may be a viral vector such as a lentiviral vector, a gamma-retroviral vector, a recombinant AAV, an adenoviral vector and an oncolytic viral vector. In other aspects, non-viral vectors for example, nanoparticles and liposomes may also be used. In some embodiments, immune cells of the present disclosure are genetically modified to express at least one immunotherapeutic agent described herein which is tunable using a stimulus. In some examples, two, three or more immunotherapeutic agents constructed in the same CA2 biocircuit and CA2 effector module are introduced into a cell. In other examples, two, three, or more biocircuits, effector modules, each of which comprises an immunotherapeutic agent, may be introduced into a cell.

In some embodiments, immune cells of the present disclosure may be T cells modified to express an antigen-specific T cell receptor (TCR), or an antigen specific chimeric antigen receptor (CAR) taught herein (known as CAR T cells). Accordingly, at least one polynucleotide encoding a CAR system (or a TCR) described herein, or a vector comprising the polynucleotide is introduced into a T cell. The T cell expressing the CAR or TCR binds to a specific antigen via the extracellular targeting moiety of the CAR or TCR, thereby a signal via the intracellular signaling domain (s) is transmitted into the T cell, and as a result, the T cell is activated. The activated CAR T cell changes its behavior including release of a cytotoxic cytokine (e.g., a tumor necrosis factor, and lymphotoxin, etc.), improvement of a cell proliferation rate, change in a cell surface molecule, or the like. Such changes cause destruction of a target cell expressing the antigen recognized by the CAR or TCR In addition, release of a cytokine or change in a cell surface molecule stimulates other immune cells, for example, a B cell, a dendritic cell, a NK cell, and a macrophage.

In some embodiments, CAR T cells of the present disclosure may be further modified to express another one, two, three or more immunotherapeutic agents. The immunotherapeutic agents may be another CAR or TCR specific to a different target molecule; a cytokine such as IL2, IL12, IL15 and IL18, or a cytokine receptor such as IL15Ra; a chimeric switch receptor that converts an inhibitory signal to a stimulatory signal; a homing receptor that guides adoptively transferred cells to a target site such as the tumor tissue; an agent that optimizes the metabolism of the immune cell; or a safety switch gene (e.g., a suicide gene) that kills activated T cells when a severe event is observed after adoptive cell transfer or when the transferred immune cells are no-longer needed. These molecules may be included in the same effector module or in separate effector modules.

In related embodiments of the above, an engineered cell, for example, an immune cell as described herein can be genetically manipulated to express one or more immunotherapeutic agents, wherein one or more of the immunotherapeutic agents are regulated using the effector modules described herein. In an exemplary embodiment, an engineered cell comprises: i) a first polynucleotide which encodes a first polypeptide, said first polypeptide comprising: (a) a first stimulus response element (SRE), wherein the first SRE comprises a drug responsive domain (DRD), said DRD comprising human carbonic anhydrase 2 (CA2; SEQ ID NO. 5810) or a region thereof, and further comprising one or more mutations relative to the amino acid sequence of SEQ ID NO. 5810; and (b) a first payload which is operably linked to the first SRE, wherein the first payload comprises membrane-associated Interleukin 12 (IL12); and ii) a second polynucleotide which encodes one or more additional polypeptides, said one or more additional polypeptides comprising an immunotherapeutic agent selected from the group consisting of: a T cell receptor (TCR) and variants thereof and a chimeric antigen receptor (CAR); wherein the DRD and the first payload are destabilized in the absence of a first stimulus and wherein the DRD and the first payload are stabilized in the presence of the first stimulus, and the one or more additional polypeptides are expressed independently of the first payload.

In various embodiments, payloads of the engineered cells can include: i) mbIL12, comprising a human IL12 subunit alpha or "IL-12A (p35)", or variants and mutants thereof, a human Interleukin-12 subunit beta; IL12B, (p40), or variants and mutants thereof, optionally, at least one of: a linker, a transmembrane domain, a tail; and ii) an additional (or second) heterogeneous immunotherapeutic agent, for example, a CAR or a TCR Illustrative engineered cells as provided above having a second immunotherapeutic agent polypeptide, along with a regulated first immunotherapeutic agent, for example, mbIL12. The second immunotherapeutic agent polypeptide may be linked to a second SRE comprising a second DRD, and in some examples, the second DRD is the same or different as the DRD in the first SRE linked to the first payload or immunotherapeutic agent polypeptide, and the second DRD and the second polypeptide are both destabilized in the absence of the first or a second stimulus and wherein the second DRD and the second polypeptide are stabilized in the presence of the first or the second stimulus. In some embodiments, the engineered cell comprises a first payload e.g. mbIL12 operably linked to a first DRD and a second immunotherapeutic agent, for example, a CAR or TCR, is introduced into the engineered cell such that the second immunotherapeutic agent, for example, a CAR or TCR, is expressed independently from the first payload, and the nucleic acid sequences encoding the second immunotherapeutic agent may be stably integrated into the engineered cell's genome such that the second immunotherapeutic agent is constitutively expressed or expressed in an inducible manner using an inducible promoter in the engineered cell. In various embodiments, the engineered cell is an engineered immune cell selected from a CD8+ T cell, a CD4+ T cell, a helper T cell, a natural killer (NK) cell, a NKT cell, a cytotoxic T lymphocyte (CTL), a tumor infiltrating lymphocyte (IL), a memory T cell, a regulatory T (Treg) cell, a cytokine-induced killer (CIK) cell, a dendritic cell, lymphokine activated killer (LAK) cells, a human embryonic stem cell, a mesenchymal stem cell, a hematopoietic stem cell, or a mixture thereof.

In one embodiment, the CAR T cell (including TCR T cell) of the present disclosure may be an "armed" CAR T cell which is transformed with a CA2 effector module comprising a CAR and a CA2 effector module comprising a cytokine. The inducible or constitutively secreted active cytokines further armor CAR T cells to improve efficacy and persistence. In this context, such CAR T cell is also referred to as "armored CAR T cell". The "armor" molecule may be selected based on the tumor microenvironment and other elements of the innate and adaptive immune systems. In some embodiments, the molecule may be a stimulatory factor such as IL2, IL12, IL15, IL18, type I IFN, CD40L and 4-1BBL which have been shown to further enhance CAR T cell efficacy and persistence in the face of a hostile tumor microenvironment via different mechanisms (Yeku et al., Biochem Soc Trans., 2016, 44(2): 412418).

In some embodiments, immune cells of the present disclosure may be NK cells modified to express an antigen-specific T cell receptor (TCR), or an antigen specific chimeric antigen receptor (CAR) taught herein.

NK cells may be isolated from peripheral blood mononuclear cells (PBMCs) or derived from human embryonic stem (ES) cells and induced pluripotent stem cells (iPSCs). The primary NK cells isolated from PBMCs may be further expanded for adoptive immunotherapy. Strategies and protocols useful for the expansion of NK cells may include interleukin 2 (IL2) stimulation and the use of autologous feeder cells, or the use of genetically modified allogeneic feeder cells. In some aspects, NK cells can be selectively expanded with a combination of stimulating ligands including IL15, IL21, IL2, 41BBL, IL12, IL18, MICA, 2B4, LFA-1, and BCM1/SLAMF2 (e.g., US patent publication NO. US20150190471).

Immune cells expressing CA2 effector modules comprising a CAR and/or other immunotherapeutic agents can be used as cancer immunotherapy. The immunotherapy comprises the cells expressing a CAR and/or other immunotherapeutic agents as an active ingredient and may further comprise a suitable excipient. Examples of the excipient may include the aforementioned pharmaceutically acceptable excipients, including various cell culture media, and isotonic sodium chloride.

In some embodiments, cells of the present disclosure may be dendritic cells that are genetically modified to express the compositions of the present disclosure. Such cells may be used as cancer vaccines.

V. Definitions

At various places in the present specification, features or functions of the compositions of the present disclosure are disclosed in groups or in ranges. It is specifically intended that the present disclosure include each and every individual sub combination of the members of such groups and ranges. The following is a non-limiting list of term definitions.

Activity: As used herein, the term "activity" refers to the condition in which things are happening or being done. Compositions described herein may have activity and this activity may involve one or more biological events. In some embodiments, biological events may include cell signaling events. In some embodiments, biological events may include cell signaling events associated protein interactions with one or more corresponding proteins, receptors, small molecules or any of the biocircuit components described herein.

Adoptive cell therapy (ACT): The terms "Adoptive cell therapy" or "Adoptive cell transfer", as used herein, refer to a cell therapy involving in the transfer of cells into a patient, wherein cells may have originated from the patient, or from another individual, and are engineered (altered) before being transferred back into the patient. The therapeutic cells may be derived from the immune system, such as effector immune cells: CD4+ T cell; CD8+ T cell, Natural Killer cell (NK cell); and B cells and tumor infiltrating lymphocytes (TILs) derived from the resected tumors. Most commonly transferred cells are autologous anti-tumor T cells after ex vivo expansion or manipulation. For example, autologous peripheral blood lymphocytes can be genetically engineered to recognize specific tumor antigens by expressing T-cell receptors (TCR) or chimeric antigen receptor (CAR).

Agent: As used herein, the term "agent" refers to a biological, pharmaceutical, or chemical compound. Non-limiting examples include simple or complex organic or inorganic molecule, a peptide, a protein, an oligonucleotide, an antibody, an antibody derivative, antibody fragment, a receptor, and soluble factor.

Agonist: the term "agonist" as used herein, refers to a compound that, in combination with a receptor, can produce a cellular response. An agonist may be a ligand that directly binds to the receptor. Alternatively, an agonist may combine with a receptor indirectly by, for example, (a) forming a complex with another molecule that directly binds to the receptor, or (b) otherwise resulting in the modification of another compound so that the other compound directly binds to the receptor. An agonist may be referred to as an agonist of a particular receptor or family of receptors, e.g., agonist of a co-stimulatory receptor.

Antagonist: the term "antagonist" as used herein refers to any agent that inhibits or reduces the biological activity of the target(s) it binds.

Antigen: the term "antigen" as used herein is defined as a molecule that provokes an immune response when it is introduced into a subject or produced by a subject such as tumor antigens which arise by the cancer development itself. This immune response may involve either antibody production, or the activation of specific immunologically-competent cells such as cytotoxic T lymphocytes and T helper cells, or both. An antigen can be derived from organisms, subunits of proteins/antigens, killed or inactivated whole cells or lysates. In the context of the present disclosure, the terms "antigens of interest" or "desired antigens" refers to those proteins and/or other biomolecules provided herein that are immunospecifically bound or interact with antibodies of the present disclosure and/or fragments, mutants, variants, and/or alterations thereof described herein. In some embodiments, antigens of interest may comprise any of the polypeptides or payloads or proteins described herein, or fragments or portions thereof.

Approximately: As used herein, the term "approximately" or "about," as applied to one or more values of interest, refers to a value that is similar to a stated reference value. In certain embodiments, the term "approximately" or "about" refers to a range of values that fall within 25, 20, 19, 18, 17, 16, 15, 14, 13, 12, 11, 10, 9, 8, 7, 6, 5, 4, 3, 2, 1, or less in either direction (greater than or less than) of the stated reference value unless otherwise stated or otherwise evident from the context (except where such number would exceed 100 of a possible value).

Associated with: As used herein, the terms "associated with," "conjugated," "linked," "attached," and "tethered," when used with respect to two or more moieties, mean that the moieties are physically associated or connected with one another, either directly or via one or more additional moieties that serve as linking agents, to form a structure that is sufficiently stable so that the moieties remain physically associated under the conditions in which the structure is used, e.g., physiological conditions. An "association" need not be strictly through direct covalent chemical bonding. It may also suggest ionic or hydrogen bonding or a hybridization-based connectivity sufficiently stable such that the "associated" entities remain physically associated.

Autologous: the term "autologous" as used herein is meant to refer to any material derived from the same individual to which it is later to be re-introduced into the individual.

Barcode: the term "barcode" as used herein refers to polynucleotide or amino acid sequence that distinguishes one polynucleotide or amino acid from another.

Cancer: the term "cancer" as used herein refers a broad group of various diseases characterized by the uncontrolled growth of abnormal cells in the body. Unregulated cell division and growth results in the formation of malignant tumors that invade neighboring tissues ultimately metastasize to distant parts of the body through the lymphatic system or bloodstream.

Co-stimulatory molecule: As used herein, in accordance with its meaning in immune T cell activation, refers to a group of immune cell surface receptor/ligands which engage between T cells and APCs and generate a stimulatory signal in T cells which combines with the stimulatory signal in T cells that results from T cell receptor (TCR) recognition of antigen/MHC complex (pMHC) on APCs Cytokines: the term "cytokines", as used herein, refers to a family of small soluble factors with pleiotropic functions that are produced by many cell types that can influence and regulate the function of the immune system.

Delivery: the term "delivery" as used herein refers to the act or manner of delivering a compound, substance, entity, moiety, cargo or payload. A "delivery agent" refers to any agent which facilitates, at least in part, the in vivo delivery of one or more substances (including, but not limited to a compound and/or composition of the present disclosure) to a cell, subject or other biological system cells.

Destabilized: As used herein, the term "destable," "destabilize," "destabilizing region" or "destabilizing domain" means a region or molecule that is less stable than a starting, reference, wild-type or native form of the same region or molecule.

Destabilizing domain (DD): As used herein, the term "destabilizing domain" refers to a protein or region or domain thereof that can be operably linked to a payload of interest (POI). In the absence of a DD-binding ligand, the DD renders the operably linked POI unstable, such that the POI is rapidly degraded within the cell. In the presence of a DD-binding ligand, the operably linked POI is stabilized, and protein function restored. As used herein, the terms "destabilizing domain" and "drug responsive domain" (DRD) are interchangeable.

Engineered: As used herein, embodiments of the present disclosure are "engineered" when they are designed to have a feature or property, whether structural or chemical, that varies from a starting point, wild type or native molecule.

Expression: As used herein, "expression" of a nucleic acid sequence refers to one or more of the following events: (1) production of an RNA template from a DNA sequence (e.g., by transcription); (2) processing of an RNA transcript (e.g., by splicing, editing, 5' cap formation, and/or 3' end processing); (3) translation of an RNA into a polypeptide or protein; (4) folding of a polypeptide or protein; and (5) post-translational modification of a polypeptide or protein.

Feature: As used herein, a "feature" refers to a characteristic, a property, or a distinctive element.

Formulation: As used herein, a "formulation" includes at least a compound and/or composition of the present disclosure and a delivery agent.

Fragment: A "fragment," as used herein, refers to a portion. For example, fragments of proteins may comprise polypeptides obtained by digesting full-length protein. In some embodiments, a fragment of a protein includes at least 3, 4, 5, 6, 7, 8, 9, 10, 11, 12, 13, 14, 15, 16, 17, 18, 19, 20, 25, 30, 35, 40, 45, 50, 55, 60, 65, 70, 75, 80, 85, 90, 95, 100, 150, 200, 250 or more amino acids. In some embodiments, fragments of an antibody include portions of an antibody.

Functional: As used herein, a "functional" biological molecule is a biological entity with a structure and in a form in which it exhibits a property and/or activity by which it is characterized.

Immune cells: the term "an immune cell", as used herein, refers to any cell of the immune system that originates from a hematopoietic stem cell in the bone marrow, which gives rise to two major lineages, a myeloid progenitor cell (which give rise to myeloid cells such as monocytes, macrophages, dendritic cells, megakaryocytes and granulocytes) and a lymphoid progenitor cell (which give rise to lymphoid cells such as T cells, B cells and natural killer (NK) cells). Exemplary immune system cells include a CD4+ T cell, a CD8+ T cell, a CD4− D8− double negative T cell, a T γδ cell, a Tαβ cell, a regulatory T cell, a natural killer cell, and a dendritic cell. Macrophages and dendritic cells may be referred to as "antigen presenting cells" or "APCs," which are specialized cells that can activate T cells when a major histocompatibility complex (MHC) receptor on the surface of the APC complexed with a peptide interacts with a TCR on the surface of a T cell.

Immunotherapy the term "immunotherapy" as used herein, refers to a type of treatment of a disease by the induction or restoration of the reactivity of the immune system towards the disease.

Immunotherapeutic agent: The term "immunotherapeutic agent" as used herein, refers to a biological, pharmaceutical, or chemical compound capable of being used for the treatment of disease by the induction or restoration of the reactivity of the immune system towards the disease.

In vitro: As used herein, the term "in vitro" refers to events that occur in an artificial environment, e.g., in a test tube or reaction vessel, in cell culture, in a Petri dish, etc., rather than within an organism (e.g., animal, plant, or microbe).

In vivo: As used herein, the term "in vivo" refers to events that occur within an organism (e.g., animal, plant, or microbe or cell or tissue thereof).

Linker: As used herein, a linker refers to a moiety that connects two or more domains, moieties or entities. In one embodiment, a linker may comprise 10 or more atoms. In a further embodiment, a linker may comprise a group of atoms, e.g., 10-1,000 atoms, and can be comprised of the atoms or groups such as, but not limited to, carbon, amino, alkylamino, oxygen, sulfur, sulfoxide, sulfonyl, carbonyl, and imine. In some embodiments, a linker may comprise one or more nucleic acids comprising one or more nucleotides. In some embodiments, the linker may comprise an amino acid, peptide, polypeptide or protein. In some embodiments, a moiety bound by a linker may include, but is not limited to an atom, a chemical group, a nucleoside, a nucleotide, a nucleobase, a sugar, a nucleic acid, an amino acid, a peptide, a polypeptide, a protein, a protein complex, a payload (e.g., a therapeutic agent). or a marker (including, but not limited to a chemical, fluorescent, radioactive or bioluminescent marker). The linker can be used for any useful purpose, such as to form multimers or conjugates, as well as to administer a payload, as described herein. Examples of chemical groups that can be incorporated into the linker include, but are not limited to, alkyl, alkenyl, alkynyl, amido, amino, ether, thioether, ester, alkylene, heteroalkylene, aryl, or heterocy-clyl, each of which can be optionally substituted, as described herein. Examples of linkers include, but are not limited to, unsaturated alkanes, polyethylene glycols (e.g., ethylene or propylene glycol monomeric units, e.g., diethylene glycol, dipropylene glycol, triethylene glycol, tripropylene glycol, tetraethylene glycol, or tetraethylene glycol), and dextran polymers, Other examples include, but are not limited to, cleavable moieties within the linker, such as, for example, a disulfide bond (—S—S—) or an azo bond (—N═N—), which can be cleaved using a reducing agent or photolysis. Non-limiting examples of a selectively cleavable bonds include an amido bond which may be cleaved for example by the use of tris(2-carboxyethyl) phosphine (TCEP), or other reducing agents, and/or photolysis, as well as an ester bond which may be cleaved for example by acidic or basic hydrolysis.

Checkpoint/factor: As used herein, a checkpoint factor is any moiety or molecule whose function acts at the junction of a process. For example, a checkpoint protein, ligand or receptor may function to stall or accelerate the cell cycle.

Metabolite: Metabolites are the intermediate products of metabolic reactions catalyzed by enzymes that naturally occur within cells. This term is usually used to describe small molecules, fragments of larger biomolecules or processed products.

Modified: As used herein, the term "modified" refers to a changed state or structure of a molecule or entity as compared with a parent or reference molecule or entity. Molecules may be modified in many ways including chemically, structurally, and functionally. In some embodiments, compounds and/or compositions of the present disclosure are modified by the introduction of non-natural amino acids.

Mutation: As used herein, the term "mutation" refers to a change and/or alteration. In some embodiments, mutations may be changes and/or alterations to proteins (including peptides and polypeptides) and/or nucleic acids (including polynucleic acids). In some embodiments, mutations comprise changes and/or alterations to a protein and/or nucleic acid sequence. Such changes and/or alterations may comprise the addition, substitution and or deletion of one or more amino acids (in the case of proteins and/or peptides) and/or nucleotides (in the case of nucleic acids and or polynucleic acids e.g., polynucleotides). In some embodiments, wherein mutations comprise the addition and/or substitution of amino acids and/or nucleotides, such additions and/or substitutions may comprise 1 or more amino acid and/or nucleotide residues and may include modified amino acids and/or nucleotides. The resulting construct, molecule or sequence of a mutation, change or alteration may be referred to herein as a mutant.

Neoantigen: the term "neoantigen", as used herein, refers to a tumor antigen that is present in tumor cells but not normal cells and do not induce deletion of their cognate antigen specific T cells in thymus (i.e., central tolerance). These tumor neoantigens may provide a "foreign" signal, similar to pathogens, to induce an effective immune response needed for cancer immunotherapy. A neoantigen may be restricted to a specific tumor. A neoantigen be a peptide/protein with a missense mutation (missense neoantigen), or a new peptide with long, completely novel stretches of amino acids from novel open reading frames (neoORFs). The neoORFs can be generated in some tumors by out-of-frame insertions or deletions (due to defects in DNA mismatch repair causing microsatellite instability), gene-fusion, read-through mutations in stop codons, or translation of improperly spliced RNA (e.g., Saeterdal et al., *Proc Natl Acad Sci USA,* 2001, 98: 13255-13260).

Off-target: As used herein, "off target" refers to any unintended effect on any one or more target, gene, cellular transcript, cell, and/or tissue.

Operably linked: As used herein, the phrase "operably linked" refers to a functional connection between two or more molecules, constructs, transcripts, entities, moieties or the like.

Payload or payload of interest (POI): The terms "payload" and "payload of interest (POI)", as used herein, are used interchangeably. A payload of interest (POI) refers to any polypeptide or protein that is operably linked to a destabilizing domain (DD). In the context of the present disclosure, the POI is a component in the immune system, including both innate and adaptive immune systems. A payload of interest may be referred to as a protein of interest.

Pharmaceutically acceptable excipients: the term "pharmaceutically acceptable excipient," as used herein, refers to any ingredient other than active agents (e.g., as described herein) present in pharmaceutical compositions and having the properties of being substantially nontoxic and non-inflammatory in subjects. In some embodiments, pharmaceutically acceptable excipients are vehicles capable of suspending and/or dissolving active agents. Excipients may include, for example: antiadherents, antioxidants, binders, coatings, compression aids, disintegrants, dyes (colors), emollients, emulsifiers, fillers (diluents), film formers or coatings, flavors, fragrances, glidants (flow enhancers), lubricants, preservatives, printing inks, sorbents, suspending or dispersing agents, sweeteners, and waters of hydration. Exemplary excipients include, but are not limited to: butylated hydroxytoluene (BHT), calcium carbonate, calcium phosphate (dibasic), calcium stearate, croscarmellose, cross-linked polyvinyl pyrrolidone, citric acid, crospovidone, cysteine, ethylcellulose, gelatin, hydroxypropyl cellulose, hydroxypropyl methylcellulose, lactose, magnesium stearate, maltitol, mannitol, methionine, methylcellulose, methyl paraben, microcrystalline cellulose, polyethylene glycol, polyvinyl pyrrolidone, povidone, pregelatinized starch, propyl paraben, retinyl palmitate, shellac, silicon dioxide, sodium carboxymethyl cellulose, sodium citrate, sodium starch glycolate, sorbitol, starch (corn), stearic acid, sucrose, talc, titanium dioxide, vitamin A, vitamin E, vitamin C, and xylitol.

Pharmaceutically acceptable salts: Pharmaceutically acceptable salts of the compounds described herein are forms of the disclosed compounds wherein the acid or base moiety is in its salt form (e.g., as generated by reacting a free base group with a suitable organic acid). Examples of pharmaceutically acceptable salts include, but are not limited to, mineral or organic acid salts of basic residues such as amines; alkali or organic salts of acidic residues such as carboxylic acids; and the like. Representative acid addition salts include acetate, adipate, alginate, ascorbate, aspartate, benzenesulfonate, benzoate, bisulfate, borate, butyrate, camphorate, camphorsulfonate, citrate, cyclopentanepropionate, digluconate, dodecylsulfate, ethanesulfonate, fumarate, glucoheptonate, glycerophosphate, hemisulfate, heptonate, hexanoate, hydrobromide, hydrochloride, hydroiodide, 2-hydroxy-ethanesulfonate, lactobionate, lactate, laurate, lauryl sulfate, malate, maleate, malonate, methanesulfonate, 2-naphthalenesulfonate, nicotinate, nitrate, oleate, oxalate, palmitate, pamoate, pectinate, persulfate, 3-phenylpropionate, phosphate, picrate, pivalate, propionate, stearate, succinate, sulfate, tartrate, thiocyanate, toluenesulfonate, undecanoate, valerate salts, and the like. Representative alkali or alkaline earth metal salts include sodium, lithium, potassium, calcium, magnesium, and the like, as well as nontoxic ammonium, quaternary ammonium, and amine cations, including, but not limited to ammonium, tetramethylammonium, tetraethylammonium, methylamine, dimethylamine, trimethylamine, triethylamine, ethylamine, and the like. Pharmaceutically acceptable salts include the conventional non-toxic salts, for example, from non-toxic inorganic or organic acids. In some embodiments, a pharmaceutically acceptable salt is prepared from a parent compound which contains a basic or acidic moiety by conventional chemical methods. Generally, such salts can be prepared by reacting the free acid or base forms of these compounds with a stoichiometric amount of the appropriate base or acid in water or in an organic solvent, or in a mixture of the two; generally, nonaqueous media like ether, ethyl acetate, ethanol, isopropanol, or acetonitrile are preferred. Lists of suitable salts are found in Remington's Pharmaceutical Sciences, 17th ed., Mack Publishing Company, Easton, Pa., 1985, p. 1418, Pharmaceutical Salts: Properties, Selection, and Use, P. H. Stahl and C. G. Wermuth (eds.), Wiley-VCH, 2008, and Berge et al., Journal of Pharmaceutical Science, 66, 1-19 (1977), each of which is incorporated herein by reference in its entirety. Pharmaceutically acceptable solvate: The term "pharmaceutically acceptable solvate," as used herein, refers to a crystalline form of a compound wherein molecules of a suitable solvent are incorporated in the crystal lattice. For example, solvates may be prepared by crystallization, recrystallization, or precipitation from a solution that includes organic solvents, water, or a mixture thereof. Examples of suitable solvents are ethanol, water (for example, mono-, di-, and tri-hydrates), N-methylpyrrolidinone (NMP), dimethyl sulfoxide (DMSO), N, N'-dimethylformamide (DMF), N, N'-dimethylacetamide (DMAC), 1,3-dimethyl-2-imidazolidinone (DMEU), 1,3-dimethyl-3,4,5, 6-tetrahydro-2-(1H)-pyrimidinone (DMPU), acetonitrile (ACN), propylene glycol, ethyl acetate, benzyl alcohol, 2-pyrrolidone, benzyl benzoate, and the like. When water is the solvent, the solvate is referred to as a "hydrate." In some embodiments, the solvent incorporated into a solvate is of a type or at a level that is physiologically tolerable to an organism to which the solvate is administered (e.g., in a unit dosage form of a pharmaceutical composition).

Stable: As used herein "stable" refers to a compound or entity that is sufficiently robust to survive isolation to a useful degree of purity from a reaction mixture, and preferably capable of formulation into an efficacious therapeutic agent.

Stabilized: As used herein, the term "stabilize", "stabilized," "stabilized region" means to make or become stable. In some embodiments, stability is measured relative to an absolute value. In some embodiments, stability is measured relative to a secondary status or state or to a reference compound or entity.

Standard CAR: As used herein, the term "standard CAR" refers to the standard design of a chimeric antigen receptor. The components of a CAR fusion protein including the extracellular scFv fragment, transmembrane domain and one or more intracellular domains are linearly constructed as a single fusion protein.

Stimulus response element (SRE): the term "stimulus response element (SRE), as used herein, is a component of an effector module which is joined, attached, linked to or associated with one or more payloads of the effector module and in some instances, is responsible for the responsive nature of the effector module to one or more stimuli. As used herein, the "responsive" nature of an SRE to a stimulus may be characterized by a covalent or non-covalent interaction, a direct or indirect association or a structural or chemical reaction to the stimulus. Further, the response of any SRE to a stimulus may be a matter of degree or kind. The response may be a partial response. The response may be a reversible response. The response may ultimately lead to a regulated signal or output. Such output signal may be of a relative nature to the stimulus, e.g., producing a modulatory effect of between 1 and 100 or a factored increase or decrease such as 2-fold, 3-fold, 4-fold, 5-fold, 10-fold or more. One non-limiting example of an SRE is a destabilizing domain (DD).

Subject: As used herein, the term "subject" or "patient" refers to any organism to which a composition in accordance with the present disclosure may be administered, e.g., for experimental, diagnostic, prophylactic, and/or therapeutic purposes. Typical subjects include animals (e.g., mammals such as mice, rats, rabbits, non-human primates, and humans) and/or plants.

T cell: A T cell is an immune cell that produces T cell receptors (TCRs). T cells can be naïve (not exposed to antigen; increased expression of CD62L, CCR7, CD28, CD3, CD127, and CD45RA, and decreased expression of CD45RO as compared to $T_{CM}$), memory T cells ($T_M$) (antigen-experienced and long-lived), and effector cells (antigen-experienced, cytotoxic). $T_M$ can be further divided into subsets of central memory T cells ($T_{CM}$, increased expression of CD62L, CCR7, CD28, CD127, CD45RO, and CD95, and decreased expression of CD54RA as compared to naïve T cell and effector memory T cells ($T_{EM}$, decreased expression of CD62L, CCR7, CD28, CD45RA, and increased expression of CD127 as compared to naïve T cells or $T_{CM}$). Effector T cells ($T_E$) refers to antigen-experienced CD8+ cytotoxic T lymphocytes that have decreased expression of CD62L, CCR7, CD28, and are positive for granzyme and perforin as compared to $T_{CM}$. Other exemplary T cells include regulatory T cells, such as CD4+ CD25+ (Foxp3+) regulatory T cells and Treg17 cells, as well as Tr1, Th3, CD8+CD28−, and Qa-1 restricted T cells.

T cell receptor: T cell receptor (TCR) refers to an immunoglobulin superfamily member having a variable antigen binding domain, a constant domain, a transmembrane region, and a short cytoplasmic tail, which is capable of specifically binding to an antigen peptide bound to a MHC receptor. A TCR can be found on the surface of a cell or in soluble form and generally is comprised of a heterodimer having α and β chains (also known as TCRα and TCRβ, respectively), or γ and δ chains (also known as TCRγ and TCRδ, respectively). The extracellular portion of TCR chains (e.g., α-chain, β-chain) contains two immunoglobulin domains, a variable domain (e.g., α-chain variable domain or $V_\alpha$, β-chain variable domain or $V_\beta$) at the N terminus, and one constant domain (e.g., α-chain constant domain or $C_\alpha$ and β-chain constant domain or $C_\beta$,) adjacent to the cell membrane. Similar to immunoglobulin, the variable domains contain complementary determining regions (CDRs) separated by framework regions (FRs). A TCR is usually associated with the CD3 complex to form a TCR complex. As used herein, the term "TCR complex" refers to a complex formed by the association of CD3 with TCR. For example, a TCR complex can be composed of a CD3γ chain, a CD3δ chain, two CD3ε chains, a homodimer of CD3ζ chains, a TCRα chain, and a TCRβ chain. Alternatively, a TCR complex can be composed of a CD3γ chain, a CD3δ chain, two CD3ε chains, a homodimer of CD3ζ chains, a TCRγ chain, and a TCRδ chain. A "component of a TCR complex," as used herein, refers to a TCR chain (i.e., TCRα, TCRβ, TCRγ or TCRδ), a CD3 chain (i.e., CD3γ, CD3δ, CD3ε or CD3ζ), or a complex formed by two or more TCR chains or CD3 chains (e.g., a complex of TCRα and TCRβ, a complex of TCRγ and TCRδ, a complex of CD3ε and CD3δ, a complex of CD3γ and CD3ε, or a sub-TCR complex of TCRα, TCRβ, CD3γ, CD3δ, and two CD3ε chains.

Therapeutically effective amount: As used herein, the term "therapeutically effective amount" means an amount of an agent to be delivered (e.g., nucleic acid, drug, therapeutic agent, diagnostic agent, prophylactic agent, etc.) that is sufficient, when administered to a subject suffering from or susceptible to an infection, disease, disorder, and/or condition, to treat, improve symptoms of, diagnose, prevent, and/or delay the onset of the infection, disease, disorder, and/or condition. In some embodiments, a therapeutically effective amount is provided in a single dose. In some embodiments, a therapeutically effective amount is administered in a dosage regimen comprising a plurality of doses. Those skilled in the art will appreciate that in some embodiments, a unit dosage form may be considered to comprise a therapeutically effective amount of a particular agent or entity if it comprises an amount that is effective when administered as part of such a dosage regimen.

Treatment or treating: As used herein, the terms "treatment" or "treating" denote an approach for obtaining a beneficial or desired result including and preferably a beneficial or desired clinical result. Such beneficial or desired clinical results include, but are not limited to, one or more of the following: reducing the proliferation of (or destroying) cancerous cells or other diseased, reducing metastasis of cancerous cells found in cancers, shrinking the size of the tumor, decreasing symptoms resulting from the disease, increasing the quality of life of those suffering from the disease, decreasing the dose of other medications required to treat the disease, delaying the progression of the disease, and/or prolonging survival of individuals.

Tune: As used herein, the term "tune" means to adjust, balance or adapt one thing in response to a stimulus or toward a particular outcome. In one non-limiting example, the SREs and/or DDs of the present disclosure adjust, balance or adapt the function or structure of compositions to which they are appended, attached or associated with in response to particular stimuli and/or environments.

EQUIVALENTS AND SCOPE

Those skilled in the art will recognize or be able to ascertain using no more than routine experimentation, many equivalents to the specific embodiments in accordance with the present disclosure described herein. The scope of the present disclosure is not intended to be limited to the above Description, but rather is as set forth in the appended claims.

In the claims, articles such as "a," "an," and "the" may mean one or more than one unless indicated to the contrary or otherwise evident from the context. Claims or descriptions that include "or" between one or more members of a group are considered satisfied if one, more than one, or all of the group members are present in, employed in, or otherwise relevant to a given product or process unless indicated to the contrary or otherwise evident from the context. The present disclosure includes embodiments in which exactly one member of the group is present in, employed in, or otherwise relevant to a given product or process. The present disclosure includes embodiments in which more than one, or the entire group members are present in, employed in or otherwise relevant to a given product or process.

It is also noted that the term "comprising" is intended to be open and permits but does not require the inclusion of additional elements or steps. When the term "comprising" is used herein, the term "consisting of" is thus also encompassed and disclosed.

Where ranges are given, endpoints are included. Furthermore, it is to be understood that unless otherwise indicated or otherwise evident from the context and understanding of one of ordinary skill in the art, values that are expressed as ranges can assume any specific value or subrange within the stated ranges in different embodiments of the present disclosure, to the tenth of the unit of the lower limit of the range, unless the context clearly dictates otherwise.

In addition, it is to be understood that any particular embodiment of the present disclosure that falls within the prior art may be explicitly excluded from any one or more of the claims. Since such embodiments are deemed to be known to one of ordinary skill in the art, they may be excluded even if the exclusion is not set forth explicitly herein. Any particular embodiment of the compositions of the present disclosure (e.g., any antibiotic, therapeutic or active ingredient; any method of production; any method of use; etc.) can be excluded from any one or more claims, for any reason, whether or not related to the existence of prior art.

It is to be understood that the words which have been used are words of description rather than limitation, and that changes may be made within the purview of the appended claims without departing from the true scope and spirit of the present disclosure in its broader aspects.

While the present disclosure has been described at some length and with some particularity with respect to the several described embodiments, it is not intended that it should be limited to any such particulars or embodiments or any particular embodiment, but it is to be construed with references to the appended claims so as to provide the broadest possible interpretation of such claims in view of the prior art and, therefore, to effectively encompass the intended scope of the present disclosure. The present disclosure is further illustrated by the following nonlimiting examples.

EXAMPLES

Example 1. Regulation of Membrane Bond IL12-CA2 in Primary Human CAR-T Cells T cells were transduced with a bicistronic construct (OT-002008) conferring CD19-CAR expression with CA2 DD-regulated expression of a membrane-bound form of IL12. T cells were activated, transduced with the indicated constructs, and expanded as described above. Transduced cells were treated with 100 μM acetazolamide (or vehicle as control) for 20 hours. Surface IL12 expression was detected with an anti-IL12p70 antibody (BD, Franklin Lakes, NJ). Acetazolamide treatment induced a 6-fold increase in expression of surface IL12 when compared to vehicle control. The expression of IL12 by OT-002008 expressing cells was higher than IL12 levels observed with T cells transduced with CAR only construct OT-001407 (SEQ ID NO. 5980; encoded by SEQ ID NO. 5981).

On day 0, primary human T cells were stimulated with Dynabeads (T-expander CD3/CD28) at a 3:1 bead: cell ratio in media containing 10% fetal bovine serum (FBS). The next day, lentivirus produced with constructs expressing CD19-CAR and membrane-bound flexi IL12 OT-002007, OT-002008, OT-002010, and OT-002012 were added in the presence of reduced serum (5% FBS). On day 2, the cells were diluted 1:2 with fresh 10% FBS media. Cells were expanded for a total of 10-11 days and then frozen in liquid nitrogen. Next, T cells were thawed and counted. 1-2e5 cells were plated per well of a 96-well V-bottom plate, re-stimulated with soluble CD3/CD28 Immunocult reagent (Stem Cell Technologies) and treated with a dose response of acetazolamide ranging from 0-100 μM. After incubation for 24 hours, payload expression was analyzed by flow cytometry using CD19-Fc to detect surface CAR expression. Surface IL12 expression was detected with an anti-IL12p70 antibody (BD). The Geometric MFI of surface IL12p70 expression on CAR+ cells is shown in Table 10. These values may be used to fit a dose response curve fits using Prism Software.

TABLE 10

| Surface IL12 MFI | | | | |
|---|---|---|---|---|
| Ligand Concentration (μM) | OT-002007 | OT-002008 | OT-002010 | OT-002012 |
| 100 | 7835 | 6432 | 9871 | 6616 |
| 33 | 5592 | 5222 | 7760 | 5061 |
| 11.1 | 4383 | 3869 | 5678 | 3822 |
| 3.7 | 4132 | 3281 | 5043 | 3070 |
| 1.2 | 3800 | 3315 | 4385 | 2894 |
| 0.41 | 3743 | 2778 | 4531 | 2778 |
| 0.14 | 3716 | 2919 | 4530 | 2734 |
| 0.046 | 3597 | 3018 | 4581 | 2934 |
| 0.015 | 3749 | 3099 | 4700 | 2814 |
| 0.001 | 3665 | 2971 | 4411 | 2858 |

As shown in Table 10, OT-002010 showed dynamic dose response to Acetazolamide with low expression at the lowest concentrations of ligand and strong induction in the presence of ligand. These data show that CA2 DDs are able to regulate membrane bound IL12 payloads.

Example 2. Expression of Membrane Bound IL12-CA2 Constructs

On day 0, primary human T cells were stimulated with Dynabeads (T-expander CD3/CD28) at a 3:1 bead: cell ratio in media containing 10% fetal bovine serum (FBS). The next day, lentivirus produced with constructs OT-002007, OT-002008, OT-002113, OT-002009, OT-002010, OT-002012, or OT-002113 were added in the presence of reduced serum (5% FBS). On day 2, the cells were diluted 1:2 with fresh 10% FBS media. On day 6, the cells were counted for equal cell number plating, media replaced, and 100 μM acetazolamide (or vehicle as control) was added for 20 hours. After overnight incubation, transduction efficiency was analyzed by flow cytometry using CD19-Fc to detect surface CAR expression. Surface IL12 expression within the CAR+ cell gate was detected with an anti-IL12p70 antibody (BD, Franklin Lakes, NJ). Acetazolamide treatment induced 4-6-fold increases in expression of surface IL12 when compared to vehicle control (Table 11).

TABLE 11

| Membrane bound IL 12 expression | | | | |
|---|---|---|---|---|
| | | IL12 Geometric Mean within CAR+ Gate | | Fold Expression |
| Construct | CAR | DMSO | Ligand | over Vehicle |
| OT-001407 | 52.9 | 249 | — | — |
| OT-001895 | 34.3 | 140686 | — | — |
| OT-002007 | 8.52 | 3720 | 9946 | 2.67 |
| OT-002008 | 4.19 | 2986 | 16726 | 5.60 |
| OT-002009 | 1.45 | 2167 | 8043 | 3.71 |
| OT-002010 | 3.78 | 4863 | 24009 | 4.94 |
| OT-002012 | 6.65 | 3233 | 12478 | 3.86 |
| OT-002113 | 11.0 | 58082 | 68995 | 1.19 |

As shown in Table 11 all concentrations tested showed ligand dependent regulation of IL12. In all instances the IL12 expression levels were less than a constitutively expressed CAR IL12 construct OT-001895. Mutant CA2 domains conferred the ability to regulate mbIL12, whereas the wild-type version of CA2 did not allow for Acetazolamide-induced regulation of mbIL12 (OT-002113).

Example 3: CA2 Regulated CD19 CAR-mbIL12 Constructs

On day 0, primary human T cells were stimulated with Dynabeads (T-expander CD3/CD28) at a 3:1 bead: cell ratio in media containing 10% fetal bovine serum (FBS). The next day, T cells were transduced with lentiviruses expressing CA2 regulated mbIL12 constructs, namely OT-002171, OT-002097, OT-002008, and OT-002098. On day 6, cells were plated, and transduction efficiency was analyzed on day 7 by flow cytometry using CD19-Fc to detect surface CAR expression. Table 12 shows the percentage of CAR positive cells.

TABLE 12

| CD19 CAR expression | | |
|---|---|---|
| Construct | % CAR positive cells | Acetazolamide EC50 (μM) |
| OT-002008 | 3.02 | ambiguous |
| OT-002097 | 2.71 | 8 μM |
| OT-002098 | 0.43 | Not determined |
| OT-002171 | 8.47 | 9 μM |

With the exception of OT-002098 all constructs showed CD19 CAR expression. On day 9, T cells were treated with a dose response of Acetazolamide ranging from 0-100 μM and the geometric median fluorescence intensity (GeoMFI) for OT-002171, OT-002097 and OT-002008 are shown in Table 13. OT-002097 and OT-002171 constructs with B7.1 transmembrane domain showed an ability to regulate mbIL12 at lower levels of Acetazolamide than the CD8 transmembrane comprising construct, OT-002008. EC50 values (shown in Table 12) were calculated using Prism Software.

TABLE 13

| GeoMFI IL12p70 (on CAR+ T cells) | | | |
| --- | --- | --- | --- |
| Ligand Concentration (µ M) | OT-002008 | OT-002097 | OT-002171 |
| 100 | 462 | 621 | 786 |
| 30 | 296 | 513 | 705 |
| 10 | 209 | 483 | 561 |
| 3 | 171 | 367 | 417 |
| 1 | 164 | 286 | 309 |
| 0.3 | 134 | 248 | 279 |
| 0.1 | 154 | 239 | 255 |
| 0.03 | 148 | 220 | 262 |
| 0.01 | 151 | 224 | 267 |
| 0.003 | 149 | 232 | 282 |
| 0.001 | 159 | 236 | 271 |
| 0 | 155 | 234 | 269 |

Example 4. Effect of mbIL12 on CAR Activity

The following constructs were transduced into T cells: OT-001356 (nucleic acid sequence SEQ ID NO: 6081 encodes two amino acid sequences, first is SEQ ID NO: 6082 (nucleic acid sequence SEQ ID NO: 6083) second is SEQ ID NO: 6084 (nucleic acid sequence SEQ ID NO: 6085)), OT-001356 (amino acid sequence provided as SEQ ID NO: 6092 and nucleic acid is SEQ ID NO: 6093) OT-001407 (amino acid sequence provided as SEQ ID NO: 6086 and nucleic acid is SEQ ID NO: 6087), OT-001895, OT-002011, OT-002111, OT-0020%, OT-02171. The cells were expanded for 10 days and utilized for cytotoxicity assays. Percentage of CAR positive cells obtained with each of the constructs was as follows: OT-001356: 45.3%; OT-001407, OT-001895: 29.4%, OT-002011: 24.3%, OT-002111: 19.6%, OT-0020%: 6.08%, OT-002171: 13.3%.

For cytotoxicity assays, T cells were thawed and co-cultured with Nalm-6 cells (stably expressing NucRed) at different T cells to Nalm-6 cell culture ratios. Target cell viability was determined by measuring cellular fluorescence over time using an Incucyte assay and the results are shown in Table 14.

TABLE 14

| 48 hour Cytotoxicity Assay | | |
| --- | --- | --- |
| Construct | Average Total Nalm6-NucRed Area after 48 hour at E:T ratio of 3:1 | Average Total Nalm6-NucRed Area after 48 hour at E:T ratio of 10:1 |
| Nalm6-NucRed Only control | — | 200,043 |
| Empty Vector control | 137,399 | 207,080 |
| OT-001407 (control) | 18,266 | 32,191 |
| OT-001356 | 33,079 | 32,236 |
| OT-001357 | 50,745 | 39,476 |
| OT-001895 | 43,856 | 38,089 |
| OT-002011 | 59,465 | 44,301 |
| OT-002111 | 42,520 | 42,899 |
| OT-002096 | 109,904 | 68,898 |
| OT-002171 + vehicle | 45,334 | 52,947 |

The data in Table 14 demonstrate that mbIL12 expressing CAR-Ts are equally efficacious as either control CAR-Ts or CAR-Ts expressing secreted IL12. Additionally, the IFN-gamma analysis (measured by MSD) provided similar results to previous analysis of the constructs.

Example 5. Does-Responsive Regulation of CD19-CAR-P2A-mbIL12-CA2 in Primary Human CAR-T Cells T cells from Example 2 were further expanded for a total of 10 days and then frozen in liquid nitrogen. Next, T cells were thawed and counted. 1-2e5 cells were plated per well of a %-well V-bottom plate, re-stimulated with soluble CD3/CD28 Immunocult reagent (Stem Cell Technologies) and treated with a dose response of acetazolamide ranging from 0-100 µM. After incubation for 24 hours, payload expression was analyzed by flow cytometry using CD19-Fc to detect surface CAR expression. Surface IL12 expression was detected with an anti-IL12p70 antibody (BD). The Geometric MFI of surface IL12p70 expression on CAR+ cells is shown in Table 15.

TABLE 15

| Surface mbIL12 Geometric Mean on CAR+ T Cells | | | | |
| --- | --- | --- | --- | --- |
| Ligand Concentration (µM) | OT-002007 | OT-002008 | OT-002010 | OT-002012 |
| 100 | 7835 | 6432 | 9871 | 6616 |
| 33 | 5592 | 5222 | 7760 | 5061 |
| 11.1 | 4383 | 3869 | 5678 | 3822 |
| 3.7 | 4132 | 3281 | 5043 | 3070 |
| 1.2 | 3800 | 3315 | 4385 | 2894 |
| 0.41 | 3743 | 2778 | 4531 | 2778 |
| 0.14 | 3716 | 2919 | 4530 | 2734 |
| 0.046 | 3597 | 3018 | 4581 | 2934 |
| 0.015 | 3749 | 3099 | 4700 | 2814 |
| 0.001 | 3665 | 2971 | 4411 | 2858 |

A repeat dose response experiment run on fresh cells with two additional constructs showed similar results. On day 0, primary human T cells were stimulated with Dynabeads (T-expander CD3/CD28) at a 3:1 bead: cell ratio in media containing 10% fetal bovine serum (FBS). The next day, lentivirus produced with constructs expressing CD19-CAR and membrane-bound flexi-IL12 OT-002007, OT-002008, OT-002010, OT-002012, OT-002166, or OT-002167 were added in the presence of reduced serum (5% FBS). On day 2, the cells were diluted 1:2 with fresh 10% FBS media. Transduction efficiencies quantitated on day 7 (percent CAR+) are shown in Table 16.

TABLE 16

| CD19 CAR expression | |
| --- | --- |
| Construct | % CAR positive cells |
| OT-002008 | 4.19 |
| OT-002007 | 8.52 |
| OT-002010 | 3.78 |
| OT-002012 | 6.65 |
| OT-002113 | 11.0 |
| OT-002166 - 12 µL virus | 14.5 |
| OT-002166 - 4 µL virus | 9.21 |
| OT-002167 - 12 µL virus | 9.49 |
| OT-002167 - 4 µL virus | 5.86 |

On day 9 T cells were treated with a dose response of acetazolamide ranging from 0-300 µM. After incubation for 20 hours, payload expression was analyzed by flow cytometry using CD19-Fc to detect surface CAR expression. Surface IL12 expression was detected with an anti-IL12p70 antibody (BD). The Geometric Mean of surface IL12p70 expression on CAR+ cells is shown in Table 17.

TABLE 17

| Ligand | | | | | | OT-002166 | | OT-002167 | |
| Concentration (µM) | OT-002008 | OT-002007 | OT-002010 | OT-002012 | OT-002113 | 12 µL virus | 4 µL virus | 12 µL virus | 4 µL virus |
| --- | --- | --- | --- | --- | --- | --- | --- | --- | --- |
| 0.001 | 2860 | 4074 | 3926 | 2962 | 31236 | 3386 | 2094 | 4329 | 2490 |
| 0.0046 | 2778 | 4014 | 3759 | 2939 | 30950 | 3320 | 2104 | 4239 | 2433 |
| 0.014 | 2754 | 3782 | 3828 | 2895 | 33530 | 3288 | 2114 | 4258 | 2436 |
| 0.041 | 2763 | 3795 | 4039 | 2873 | 35909 | 3255 | 2072 | 4101 | 2386 |
| 0.123 | 2757 | 3991 | 3919 | 3046 | 36767 | 3294 | 2126 | 4303 | 2381 |
| 0.37 | 2965 | 4057 | 4113 | 3006 | 37037 | 3321 | 2094 | 4207 | 2460 |
| 1.11 | 3025 | 3941 | 4254 | 3031 | 37209 | 3502 | 2274 | 4523 | 2605 |
| 3.3 | 3321 | 4234 | 4643 | 3295 | 37919 | 3875 | 2410 | 4652 | 2728 |
| 10 | 4135 | 4536 | 5644 | 3920 | 37361 | 4612 | 3003 | 5657 | 3326 |
| 30 | 6308 | 5680 | 8898 | 5406 | 37717 | 6800 | 4774 | 7838 | 5233 |
| 100 | 9600 | 7375 | 13936 | 7877 | 38952 | 9705 | 7106 | 10989 | 7178 |
| 300 | 14682 | 10570 | 21074 | 12846 | 37799 | 13733 | 10360 | 15652 | 11084 |

Surface IL12 Geometric Mean on CAR+ Cells Expressing mbIL12-CA2

While the present disclosure has been described at some length and with some particularity with respect to the several described embodiments, it is not intended that it should be limited to any such particulars or embodiments or any particular embodiment, but it is to be construed with references to the appended claims so as to provide the broadest possible interpretation of such claims in view of the prior art and, therefore, to effectively encompass the intended scope of the present disclosure.

All publications, patent applications, patents, and other references mentioned herein are incorporated by reference in their entirety. In case of conflict, the present specification, including definitions, will control. In addition, section headings, the materials, methods, and examples are illustrative only and not intended to be limiting.

SEQUENCE LISTING (6165 sequences)

SEQ ID NO: 1 - protein, 253 aa, Homo sapiens
MWPPGSASQPPPSPAAATGLHPAARPVSLQCRLSMCPARSLLLVATLVLLDHLSLARNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNAS

SEQ ID NO: 2 - protein, 239 aa, Homo sapiens
MWPPGSASQPPPSPAAATGLHPAARPVSLQCRLSMCPARSLLLVATLVLLDHLSLARNLPVATPDPGMFPCLHHSQNLLRAVSNMLQKARQTLEFYPCTSEEIDHEDITKDKTSTVEACLPLELTKNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNAS

SEQ ID NO: 3 - protein, 215 aa, Homo sapiens
MWPPGSASQPPPSPAAATGLHPAARPVSLQCRLSMCPARSLLLVATLVLLDHLSLARNLPVATPDPGMFPCLHHSQNLLRAVSNMLQKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNAS

SEQ ID NO: 4 - protein, 328 aa, Homo sapiens
MCHQQLVISWFSLVFLASPLVAIWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCS

SEQ ID NO: 5-6 - skipped (2 entries)

SEQ ID NO: 7 - DNA, 1522 bp, Homo sapiens
acggggcgtccggctaaggccggggacccagggtggtgggcggggtgtcccgcccgcctgtggaccccgcgcagtaactgcgaacatttcgctttcattttgggccgagctggaggcggcggggccgtcccggaacggctgcggccgggcaccccgggagttaatccgaaagcgccgcaagccccgcgggccggccgcaccgcacgtgtcaccgagaagctgatgtagagagagacacagaaggagacagaaagcaagagaccagagtcccgggaaagtcctgccgcgcctcgggacaattataaaaatgtggccccctgggtcagcctcccagccaccgccctcacctgccgcggccacaggtctgcatccagcggctcgccctgtgtccctgcagtgccggctcagcatgtgtccagcgcgcagcctcctccttgtggctaccctggtcctcctggaccacctcagtttggccagaaacctccccgtggccactccagacccaggaatgttcccatgccttcaccactcccaaaacctgctgagggccgtcagcaacatgctccagaaggccagacaaactctagaattttacccttgcacttctgaagagattgatcatgaagatatcacaaaagataaaaccagcacagtggaggcctgtttaccattggaattaaccaagaatgagagttgcctaaattccagagagacctctttcataactaatgggagttgcctggcctccagaaagacctcttttatgatggccctgtgccttagtagtatttatgaagacttgaagatgtaccaggtggagttcaagaccatgaatgcaaagcttctgatggatcctaagaggcagatctttctagatcaaaacatgctggcagttattgatgagctgatgcaggccctgaatttcaacagtgagactgtgccacaaaaatcctcccttgaagaaccggatttttataaaactaaaatcaagctctgcatacttcttcatgctttcagaattcgggcagtgactattgatagagtgatgagctatctgaatgcttcctaaaaagcgaggtccctccaaaccgttgtcatttttataaaactttgaaatgaggaaactttgataggatgtggattaagaactagggagggggaaagaaggatgggactattacatccacatgatacctctgatcaagtatttttgacatttactgtggataaattgtttttaagttttcatgaatgaattgctaagaagggaaaatatccatcctgaaggtgtttttcattcactttaatagaagggcaaatatttataagctatttctgtaccaaagtgtttgtggaaacaaacatgtaagcataacttattttaaaatatttatttatataacttggtaatcatgaaagcatctgagctaacttatatttatttatgttatatttattaaattatttatcaagtgtatttgaaaaatatttttaagtgttctaaaaataaaagtattgaatt

SEQ ID NO: 8 - DNA, 1283 bp, Homo sapiens
cgtgtcaccgagaagctgatgtagagagagacacagaaggagacagaaagcaagagaccagagtcccgggaaagtcctgccgcgcctcgggacaattataaaaatgtggccccctgggtcagcctcccagccaccgccctcacctgccgcggccacaggtctgcatccagcggctcgccctgtgtccctgcagtgccggctcagcatgtgtccagcgcgcagcctcctccttgtggctaccctggtcctcctggaccacctcagtttggccagaaacctccccgtggccactccagacccaggaatgttcccatgccttcaccactcccaaaacctgctgagggccgtcagcaacatgctccagaaggccagacaaactctagaattttacccttgcacttctgaagagattgatcatgaagatatcacaaaagataaaaccagcacagtggaggcctgtttaccattggaattaaccaagaatgggagttgcctggcctccagaaagacctcttttatgatggccctgtgccttagtagtatttatgaagacttgaagatgtaccaggtggagttcaagaccatgaatgcaaagcttctgatggatcctaagaggcagatctttctagatcaaaacatgctggcagttattgatgagctgatgcaggccctgaatttcaacagtgagactgtgccacaaaaatcctcccttgaagaaccggatttttataaaactaaaatcaagctctgcatacttcttcatgctttcagaattcgggcagtgactattgatagagtgatgagctatctgaatgcttcctaaaaagcgaggtccctccaaaccgttgtcatttttataaaactttgaaatgaggaaactttgataggatgtggattaagaactagggagggggaaagaaggatgggactattacatccacatgatacctctgatcaagtatttttgacatttactgtggataaattgtttttaagttttcatgaatgaattgctaagaagggaaaatatccatcctgaaggtgtttttcattcactttaatagaagggcaaatatttataagctatttctgtaccaaagtgtttgtggaaacaaacatgtaagcataacttattttaaaatatttatttatataacttggtaatcatgaaagcatctgagctaacttatatttatttatgttatatttattaaattatttatcaagtgtatttgaaaaatatttttaagtgttctaaaaataaaagtattgaattaaagtga

SEQ ID NO: 9 - DNA, 863 bp, Homo sapiens
cgtgtcaccgagaagctgatgtagagagagacacagaaggagacagaaagcaagagaccagagtcccgggaaagtcctgccgcgcctcgggacaattataaaaatgtggccccctgggtcagcctcccagccaccgccctcacctgccgcggccacaggtctgcatccagcggctcgccctgtgtccctgcagtgccggctcagcatgtgtccagcgcgcagcctcctccttgtggctaccctggtcctcctggaccacctcagtttggccagaaacctccccgtggccactccagacccaggaatgttcccatgccttcaccactcccaaaacctgctgagggccgtcagcaacatgctccagaagaatgagagttgcctaaattccagagagacctctttcataactaatgggagttgcctggcctccagaaagacctcttttatgatggccctgtgccttagtagtatttatgaagacttgaagatgtaccaggtggagttcaagaccatgaatgcaaagcttctgatggatcctaagaggcagatctttctagatcaaaacatgctggcagttattgatgagctgatgcaggccctgaatttcaacagtgagactgtgccacaaaaatcctcccttgaagaaccggatttttataaaactaaaatcaagctctgcatacttcttcatgctttcagaattcgggcagtgactattgatagagtgatgagctatctgaatgcttcctaaaaagcgaggtccctccaaaccgttgtcatttttataaaactttgaaatgaggaaactttgataggatgtggattaagaactagggagggggaaagaaggatgggactattac

SEQ ID NO: 10 - DNA, 2761 bp, Homo sapiens
gggcatacagttgttccatcccgacatgaactcagcctcccgtctgaccgccccttggccttccttcttcctcgatctgtggaacccagggaatctgcctagtgctgtctccaagcaccttggccatgatgtaaacccagagaaattagcatctccatctccttccttattccccacccaaaagtcatttcctcttagttcattacctgggattttgatgtctatgttccctcctcgttattgatacacacacagagagagacaaacaaaaaaggaacttcttgaaattcccccagaaggttttgagagttgttttcaatgttgcaacaagtcagtttctagtttaagtttccatcagaaaggagtagagtatataagttccagtaccagcaacagcagcagaagaaacaacatctgtttcagggccattggactctccgtcctgcccagagcaagatgtgtcaccagcagttggtcatctcttggttttccctggtttttctggcatctcccctcgtggccatatgggaactgaagaaagatgtttatgtcgtagaattggattggtatccggatgcccctggagaaatggtggtcctcacctgtgacacccctgaagaagatggtatcacctggaccttggaccagagcagtgaggtcttaggctctggcaaaaccctgaccatccaagtcaaagagtttggagatgctggccagtacacctgtcacaaaggaggcgaggttctaagccattcgctcctgctgcttcacaaaaaggaagatggaatttggtccactgatattttaaaggaccagaaagaacccaaaaataagacctttctaagatgcgaggccaagaattattctggacgtttcacctgctggtggctgacgacaatcagtactgatttgacattcagtgtcaaaagcagcagaggctcttctgacccccaaggggtgacgtgcggagctgctacactctctgcagagagagtcagaggggacaacaaggagtatgagtactcagtggagtgccaggaggacagtgcctgcccagctgctgaggagagtctgcccattgaggtcatggtggatgccgttcacaagctcaagtatgaaaactacaccagcagcttcttcatcagggacatcatcaaacctgacccacccaagaacttgcagctgaagccattaaagaattctcggcaggtggaggtcagctgggagtaccctgacacctggagtactccacattcctacttctccctgacattctgcgttcaggtccagggcaagagcaagagagaaaagaaagatagagtcttcacggacaagacctcagccacggtcatctgccgcaaaaatgccagcattagcgtgcgggcccaggaccgctactatagctcatcttggagcgaatgggcatctgtgccctgcagttaggttctgatccaggatgaaaatttggaggaaaagtggaagatattaagcaaaatgtttaaagacacaacggaatagacccaaaaagataatttctatctgatttgctttaaaacgtttttttaggatcacaatgatatctttgctgtatttgtatagttagatgctaaatgctcattgaaacaatcagctaatttatgtatagattttccagctctcaagttgccatgggccttcatgctatttaaatatttaagtaatttatgtatttattagtatattactgttatttaacgtttgtctgccaggatgtatggaatgtttcatactcttatgacctgatccatcaggatcagtccctattatgcaaaatgtgaatttaattttatttgtactgacaacttttcaagcaaggctgcaagtacatcagttttatgacaatcaggaagaatgcagtgttctgataccagtgccatcatacacttgtgatggatgggaacgcaagagatacttacatggaaacctgacaatgcaaacctgttgagaagatccaggagaacaagatgctagttcccatgtctgtgaagacttcctggagatggtgttgataaagcaatttagggccacttacacttctaagcaagtttaatctttggatgcctgaattttaaaagggctagaaaaaaatgattgaccagcctgggaaacataacaagaccccgtctctacaaaaaaaatttaaaattagccaggcgtggtggctcatgcttgtggtcccagctgttcaggaggatgaggcaggaggatctcttgagcccaggaggtcaaggctatggtgagccgtgattgtgccactgcataccagcctaggtgacagaatgagaccctgtctcaaaaaaaaaaatgattgaaattaaaattcagctttagcttccatggcagtcctcacccccacctctctaaaagacacaggaggatgacacagaaacaccgtaagtgtctggaaggcaaaaagatcttaagattcaagagagaggacaagtagttatggctaaggacatgaaattgtcagaatggcaggtggcttcttaacagccctgtgagaagcagacagatgcaaagaaaatctggaatccctttctcattagcatgaatgaacctgatacacaattatgaccagaaaatatggctccatgaaggtgctacttttaagtaatgtatgtgcgctctgtaaagtgattacatttgtttcctgtttgtttatttatttatttatttttgcattctgaggctgaactaataaaaactcttctttgtaatc

SEQ ID NO: 11 - DNA, 1720 bp, Homo sapiens
accatttcaactttaacacagcatgatcgaaacatacaaccaaacttctccccgatctgcggccactggactgcccatcagcatgaaaatttttatgtatttacttactgtttttcttatcacccagatgattgggtcagcactttttgctgtgtatcttcatagaaggttggacaagatagaagatgaaaggaatcttcatgaagattttgtattcatgaaaacgatacagagatgcaacacaggagaaagatccttatccttactgaactgtgaggagattaaaagccagtttgaaggctttgtgaaggatataatgttaaacaaagaggagacgaagaaagaaaacagctttgaaatgcaaaaagtgttacagtgggctgaaaaaggatactacaccatgagcaacaacttggtaaccctggaaaatgggaaacagctgaccgttaaaagacaaggactctattatatctatgcccaagtcaccttctgttccaatcgggaagcttcgagtcaagctccatttatagccagcctctgcctaaagtcccccggtagattcgagagaatcttactcagagctgcaaatacccacagttccgccaaaccttgcgggcaacaatccattcacttgggaggagtatttgaattgcaaccaggtgcttcggtgtttgtcaatgtgactgatccaagccaagtgagccatggcactggcttcacgtcctttggcttactcaaactctgaacagtgtcaccttgcaggctgtggtggagctgacgctgggagtcttcataatacagcacagcggttaagcccaccccctgttaactgcctatttataaccctaggatcctccttatggagaactatttattatacactccaaggcatgtagaactgtaataagtgaattacaggtcacatgaaaccaaaacgggccctgctccataagagcttatatatctgaagcagcaaccccactgatgcagacatccagagagtcctatgaaaagacaaggccattatgcacaggttgaattctgagtaaacagcagataacttgccaagttcagttttgtttctttgcgtgcagtgtctttccatggataatgcatttgatttatcagtgaagatgcagaagggaaatggggagcctcagctcacattcagttatggttgactctgggttcctatggccttgttggagggggccaggctctagaacgtctaacacagtggagaaccgaaaccccccccccccccccgccaccctctcggacagttattcattctctttcaatctctctctctccatctctctctttcagtctctctctctcaacctctttcttccaatctctctttctcaatctctctgtttccctttgtcagtctcttccctcccccagtctctcttctcaatccccctttctaacacacacacacacacacacacacacacacacacacacacacacacacacacagagtcaggccgttgctagtcagttctcttctttccaccctgtccctatctctaccactatagatgagggtgaggagtagggagtgcagccctgagcctgcccactcctcattacgaaatgactgtatttaaaggaaatctattgtatctacctgcagtctccattgtttccagagtgaacttgtaattatcttgttatttattttttgaataataaagacctcttaacatta

SEQ ID NO: 12 - DNA, 1817 bp, Homo sapiens
catgctgcctctgccaccttctctgccagaagataccatttcaactttaacacagcatgatcgaaacatacaaccaaacttctccccgatctgcggccactggactgcccatcagcatgaaaatttttatgtatttacttactgtttttcttatcacccagatgattgggtcagcactttttgctgtgtatcttcatagaaggttggacaagatagaagatgaaaggaatcttcatgaagattttgtattcatgaaaacgatacagagatgcaacacaggagaaagatccttatccttactgaactgtgaggagattaaaagccagtttgaaggctttgtgaaggatataatgttaaacaaagaggagacgaagaaagaaaacagctttgaaatgcaaaaaggtgatcagaatcctcaaattgcggcacatgtcataagtgaggccagcagtaaaacaacatctgtgttacagtgggctgaaaaaggatactacaccatgagcaacaacttggtaaccctggaaaatgggaaacagctgaccgttaaaagacaaggactctattatatctatgcccaagtcaccttctgttccaatcgggaagcttcgagtcaagctccatttatagccagcctctgcctaaagtcccccggtagattcgagagaatcttactcagagctgcaaatacccacagttccgccaaaccttgcgggcaacaatccattcacttgggaggagtatttgaattgcaaccaggtgcttcggtgtttgtcaatgtgactgatccaagccaagtgagccatggcactggcttcacgtcctttggcttactcaaactctgaacagtgtcaccttgcaggctgtggtggagctgacgctgggagtcttcataatacagcacagcggttaagcccaccccctgttaactgcctatttataaccctaggatcctccttatggagaactatttattatacactccaaggcatgtagaactgtaataagtgaattacaggtcacatgaaaccaaaacgggccctgctccataagagcttatatatctgaagcagcaaccccactgatgcagacatccagagagtcctatgaaaagacaaggccattatgcacaggttgaattctgagtaaacagcagataacttgccaagttcagttttgtttctttgcgtgcagtgtctttccatggataatgcatttgatttatcagtgaagatgcagaagggaaatggggagcctcagctcacattcagttatggttgactctgggttcctatggccttgttggagggggccaggctctagaacgtctaacacagtggagaaccgaaaccccccccccccccccgccaccctctcggacagttattcattctctttcaatctctctctctccatctctctctttcagtctctctctctcaacctctttcttccaatctctctttctcaatctctctgtttccctttgtcagtctcttccctcccccagtctctcttctcaatccccctttctaacacacacacacacacacacacacacacacacacacacacacacacacacacagagtcaggccgttgctagtcagttctcttctttccaccctgtccctatctctaccactatagatgagggtgaggagtagggagtgcagccctgagcctgcccactcctcattacgaaatgactgtatttaaaggaaatctattgtatctacctgcagtctccattgtttccagagtgaacttgtaattatcttgttatttattttttgaataataaagacctcttaacatta

SEQ ID NO: 13 - protein, 247 aa, Artificial Sequence
  source: /note="Description of Artificial Sequence: Synthetic scFv sequence"
MAQVQLVQSGAEVKEPGSSVKVSCKASGGTFSSYAIYWVRQAPGQGLEWMGWINPDSGDTNSAQQFQGRVTMTRDTSISTAYMELSRLRSDDTAMYYCARPPRGDGPDYWGQGTLVTVSSGGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPRTFGQGTKVDIKRGLGGLVDYKDDD

SEQ ID NO: 14 - protein, 249 aa, Artificial Sequence
  source: /note="Description of Artificial Sequence: Synthetic scFv sequence"
MAQVQLVQSGAEVKEPGSSVKVSCKASGGTFSSYAIYWVRQAPGQGLEWMGWINPDSGDTNSAQQFQGRVTMTRDTSISTAYMELSRLRSDDTAMYYCARPPRGDGPDYWGQGTLVTVSSGGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPRTFGQGTKVDIKRGLGGLVDYKDDDDK

SEQ ID NO: 15 - protein, 261 aa, Artificial Sequence [sequence omitted]

SEQ ID NO: 16 - protein, 258 aa, Artificial Sequence
  source: /note="Description of Artificial Sequence: Synthetic scFv sequence"
DIQMTQSPSSLSASVGDRVTITCRASQGIRNYLAWYQQKPGKAPKLLIYAASTLQSGVPSRFSGSGSGTDFTLTISSLQPEDVATYYCQRYNRAPYTFGQGTKVEIKRGSTSGSGKPGSGEGSTKGEVQLVESGGGLVQPGRSLRLSCAASGFTFDDYAMHWVRQAPGKGLEWVSAITWNSGHIDYADSVEGRFTISRDNAKNSLYLQMNSLRAEDTAVYYCAKVSYLSTASSLDYWGQGTLVTVSSGGGGSGGGGSC

SEQ ID NO: 17 - protein, 242 aa, Artificial Sequence
  source: /note="Description of Artificial Sequence: Synthetic scFv sequence"
ALQLQQSGAELVRPGASVTLSCKASGYTFTDYEMHWVKQTPVHGLEWIGAIDPETGGTAYNQKFEGKAILTADKSSSTAYMELRSLTSEDSPVYYCARRRYYGSSSFDYWGQGTTLTVSSGGGGSGGGGSGGGGSDVQMIQTPSSLSASLGDRVTISCRASQDIGNYLNWYQQKPDGTVKLLIYYTSRLHSGVPSRFSGSGSGTEYSLTISNLEQEDIATYFCQQGSALPPTFGGGTKLEIN

SEQ ID NO: 18 - protein, 246 aa, Artificial Sequence
  source: /note="Description of Artificial Sequence: Synthetic scFv sequence"
DVKLQESGPGLVAPSQSLSITCTVSGFSLTSYAVSWVRQPPGKGLEWLGIIWSGGATNYNSALKSRLSISKDNSKSQVFLKMNGLQTDDTARYYCAREHYYGSSAMDYWGQGASITVSSGGGGSGGGGSGGGGSGIVMTQSPLSLPVSLGDQASISCRSSQSIVHSYGNTYLFWYLQKPGQSPKLLIYRVSNRFSGVPDRFSGSGSGTNFTLKISRVEAEDMGVYYCFQGTHVPYTFGGGTKLEIK

SEQ ID NO: 19 - protein, 245 aa, Artificial Sequence
  source: /note="Description of Artificial Sequence: Synthetic scFv sequence"
DVQLQESGPVLVKTGASVKMSCTASGYTFTDHFMDWVKQSHGKSLEWIGSLNPYSGGTSYNQKFKGKATLTVDKSSSTAYMELNSLTSVDSAVYYCARHNWGAYFDYWGQGTTLTVSSGGGGSGGGGSGGGGSDIVMTQAAPSVPVTPGESVSISCRSSKSLLHSNGNTYLYWFLQRPGQSPQRLIYYMSNLASGVPDRFSGRGSGTDFTLRISRVEAEDVGVYYCMQGLEDPYTFGGGTKLEIK

SEQ ID NO: 20 - protein, 246 aa, Artificial Sequence
  source: /note="Description of Artificial Sequence: Synthetic scFv sequence"
QVQLQQSGAELVKPGASVKISCKASGYAFSSYWMNWVKQRPGKGLEWIGQIYPGDGDTTYNGKFKGKATLTADKSSSTVYMQLNSLTSEDSAVYFCVRYYYGSSGYFDYWGQGTTLTVSSGGGGSGGGGSGGGGSDVQMIQTPDSLAVSLGQRATISCRASESVDNYGISFMHWYQQKPGQSPKLLIYRASNLESGIPARFSGSGSRTDFTLTINPVETDDVATYYCQQNNKDPPTFGGGTKLEIK

SEQ ID NO: 21 - protein, 248 aa, Artificial Sequence
  source: /note="Description of Artificial Sequence: Synthetic scFv sequence"
QVQLQQSGAEVKKPGSSVKVSCKASGFSLTSYAISWVRQAPGQGLEWMGGIIWSGGATNYAQKFQGRVTITADESTSTAYMELSSLRSEDTAVYYCAREHYYGSSAMDYWWGQGTMVTVSSGGGGSGGGGSGGGGSEIVLTQSPATLSLSPGERATLSCRASQSIVHSYGNTYAWYQQKPGQAPRLLIYRVSRATGIPARFSGSGSGTDFTLTISSLEPEDFAVYYCFQGTHVPYTFFGQGTKLEIKR

SEQ ID NO: 22 - protein, 247 aa, Artificial Sequence
  source: /note="Description of Artificial Sequence: Synthetic scFv sequence"
QVQLQQSGAEVKKPGSSVKVSCKASGYAFSSYISWVRQAPGQGLEWMGGQIYPGDGDTNYAQKFQGRVTITADESTSTAYMELSSLRSEDTAVYYCVRYYYGSSGYFDYWWGQGTMVTVSSGGGGSGGGGSGGGGSEIVLTQSPATLSLSPGERATLSCRASESVDNYGISFAWYQQKPGQAPRLLIYRASRATGIPARFSGSGSGTDFTLTISSLEPEDFAVYYCQQNNKDPPTFFGQGTKLEIKR

SEQ ID NO: 23 - protein, 246 aa, Artificial Sequence
  source: /note="Description of Artificial Sequence: Synthetic scFv sequence"
QVQLQQSGAEVKKPGSSVKVSCKASGYTFTDHFISWVRQAPGQGLEWMGGLNPYSGGTNYAQKFQGRVTITADESTSTAYMELSSLRSEDTAVYYCARHNWGAYFDYWWGQGTMVTVSSGGGGSGGGGSGGGGSEIVLTQSPATLSLSPGERATLSCRASKSLLHSNGNTYAWYQQKPGQAPRLLIYYMSRATGIPARFSGSGSGTDFTLTISSLEPEDFAVYYCMQGLEDPYTFFGQGTKLEIKR

SEQ ID NO: 24 - protein, 243 aa, Artificial Sequence
  source: /note="Description of Artificial Sequence: Synthetic scFv sequence"
QVQLQQSGAEVKKPGSSVKVSCKASGYTFTDYEISWVRQAPGQGLEWMGGIDPETGGTNYAQKFQGRVTITADESTSTAYMELSSLRSEDTAVYYCARRRYYGSSSFDYWWGQGTMVTVSSGGGGSGGGGSGGGGSEIVLTQSPATLSLSPGERATLSCRASQDIGNYAWYQQKPGQAPRLLIYYTSRATGIPARFSGSGSGTDFTLTISSLEPEDFAVYYCQQGSALPPTFFGQGTKLEIKR

SEQ ID NO: 25 - protein, 242 aa, Artificial Sequence
  source: /note="Description of Artificial Sequence: Synthetic scFv sequence"
QVQLQQSGAEVKKPGSSVKVSCKASGYTFTDYEISWVRQAPGQGLEWMGGIDPETGGTNYAQKFQGRVTITADESTSTAYMELSSLRSEDTAVYYCARRYYGSSSFDYWWGQGTMVTVSSGGGGSGGGGSGGGGSEIVLTQSPATLSLSPGERATLSCRASQDIGNYAWYQQKPGQAPRLLIYYTSRATGIPARFSGSGSGTDFTLTISSLEPEDFAVYYCQQGSALPPTFFGQGTKLEIKR

SEQ ID NO: 26 - protein, 477 aa, Artificial Sequence
  source: /note="Description of Artificial Sequence: Synthetic scFv sequence"
QVQLQQSGAELARPGASVKMSCKASGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSSGGGGSGGGGSGGGGSQIVLTQSPAIMSASPGEKVTMTCSASSSVSYMNWYQQKSGTSPKRWIYDTSKLASGVPAHFRGSGSGTSYSLTISGMEAEDAATYYCQQWSSNPFTFGSGTKLEINRGAAAEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 27 - protein, 241 aa, Artificial Sequence
  source: /note="Description of Artificial Sequence: Synthetic scFv sequence"
QVQLQQSGAELVKPGASVKLSCKTSGYTFTNYDINWVRQRPGQGLEWIGWIFPGDDSTQYNEKFKGKATLTTDTSSSTAYMQLSRLTSEDSAVYFCARQTTGTWFAYWGQGTLVTVSAGGGGSGGGGSGGGGSDIVMTQSPATLSVTPGDRVTLSCRASQSISDYLYWYQQKSHESPRLLIKYASQSISGIPSRFSGSGSGSDFTLSINSVEPEDVGVYYCQNGHSFPLTFGAGTKLELKR

SEQ ID NO: 28 - protein, 241 aa, Artificial Sequence
  source: /note="Description of Artificial Sequence: Synthetic scFv sequence"
QVQLVQSGAEVVKPGASCKLSCKTSGYTFTNYDINWVRQRPGQGLEWIGWIFPGDGSTQYNEKFKGKATLTTDTSTSTAYMELSSLRSEDTAVYFCARQTTATWFAYWGQGTLVTVSSGGGGSGGGGSGGVGSEIVMTQSPATLSVSPGERVTLSCRASQSIGDYLYWYQQKSHESPRLLIKYASQSISGIPARFSGSGSGSEFTLTINSVEPEDVGVYYCQNGHSFPLTFGQGTKLELKR

SEQ ID NO: 29 - protein, 200 aa, Artificial Sequence
  source: /note="Description of Artificial Sequence: Synthetic scFv sequence"
QVQLVQSGAEVVKPGASVKLSCKASGYTFTNYDINWVRQRPEQGLEWIGWIFPGDGSTQYNEKFKGKATLTTDTSTSTAYMELSSLRSEDTAVYFCARQTTATWFAYWGQGTLVTVSSGGGGSGGGGSGGGGSEIVMTQSPATLSVSPGERVSLSCRASQSISDYLHWYQQKSHESPRLLIKYASQSISGIPARFSGSGS

SEQ ID NO: 30 - protein, 241 aa, Artificial Sequence
  source: /note="Description of Artificial Sequence: Synthetic scFv sequence"
QVQLVQSGAEVVKPGASVKLSCKASGYTFTNYDINWVRQRPEQGLEWIGWIFPGDGSTQYNEKFKGKATLTTDTSTSTAYMELSSLRSEDTAVYFCARQTTATWFAYWGQGTLVTVSSGGGGSGGGGSGGGGSEIVMTQSPATLSVSPGERVSLSCRASQSISDYLHWYQQKSHESPRLLIKYASQSISGIPARFSGSGSGSEFTLTINSVEPEDVGVYYCQNGHSFPLTFGQGTKLELKR

SEQ ID NO: 31 - protein, 241 aa, Artificial Sequence
  source: /note="Description of Artificial Sequence: Synthetic scFv sequence"
QVQLVQSGAEVVKPGASVKLSCKTSGYTFTNYDINWVRQRPGQGLEWIGWIFPGDDSTQYNEKFKGKATLTTDTSTSTAYMELSSLRPEDTAVYFCARQTTGTWFAYWGQGTLVTVSSGGGGSGGGGSGGGGSEIVMTQSPATLSVSPGERVTLSCRASQSISDYLYWYQQKSHESPRLLIKYASQSIPGIPARFSGSGSGSEFTLTINSVEPEDVGVYYCQNGHSFPLTFGQGTKLELKR

SEQ ID NO: 32 - protein, 241 aa, Artificial Sequence
  source: /note="Description of Artificial Sequence: Synthetic scFv sequence"
QVQLVQSGAEVVKPGASVKLSCKTSGYTFTNYDINWVRQRPGQGLEWIGWIFPGDDSTQYNEKFKGKATLTTDTSTSTAYMELSSLRSEDTAVYFCARQTTGTWFAYWGQGTLVTVSSGGGGSGGGGSGGGGSEIVMTQSPATLSVSPGERVTLSCRASQSISDYLYWYQQKSHESPRLLIKYASQSISGIPARFSGSGSGSEFTLTINSVEPEDVGVYYCQNGHSFPLTFGQGTKLELKR

SEQ ID NO: 33 - protein, 200 aa, Artificial Sequence
  source: /note="Description of Artificial Sequence: Synthetic scFv sequence"
QVQLVQSGAEVVKPGASVKLSCKTSGYTFTNYDINWVRQRPGQGLEWIGWIFPGDGSTQYNEKFKGKATLTTDTSTSTAYLELSSLGSEDTAVYFCARQTTGTWFAYWGQGTLVTVSSGGGGSGGGGSGGGGSEIVMTQSPATLSVSPGERVTLSCRASQSISDYLYWYQQKSHESPRLLIKYASQSISGIPARFSGSGS

SEQ ID NO: 34 - protein, 241 aa, Artificial Sequence
  source: /note="Description of Artificial Sequence: Synthetic scFv sequence"
QVQLVQSGAEVVKPGASVKLSCKTSGYTFTNYDINWVRQRPGQGLEWIGWIFPGDGSTQYNEKFKGKATLTTDTSTSTAYLELSSLGSEDTAVYFCARQTTGTWFAYWGQGTLVTVSSGGGGSGGGGSGGGGSEIVMTQSPATLSVSPGERVTLSCRASQSISDYLYWYQQKSHESPRLLIKYASQSISGIPARFSGSGSGSEFTLTINSVEPEDVGVYYCQNGHSFPLTFGQGTKLELKR

SEQ ID NO: 35 - protein, 200 aa, Artificial Sequence
  source: /note="Description of Artificial Sequence: Synthetic scFv sequence"
QVQLVQSGAEVVKPGASVKLSCKTSGYTFTNYDINWVRQRPGQGLEWIGWIFPGDGSTQYNEKFKGKATLTTDTSTSTAYMELSSLGSEDTAVYFCARQTTATWFAYWGQGTLVTVSSGGGGSGGGGSGGGGSEIVMTQSPATLSVSPGERVTLSCRASQSISDYLYWYQQKSHESPRLLIKYASQSISGIPARFSGSGS

SEQ ID NO: 36 - protein, 241 aa, Artificial Sequence
  source: /note="Description of Artificial Sequence: Synthetic scFv sequence"
QVQLVQSGAEVVKPGASVKLSCKTSGYTFTNYDINWVRQRPGQGLEWIGWIFPGDGSTQYNEKFKGKATLTTDTSTSTAYMELSSLGSEDTAVYFCTRQTTATWFAYWGQGTLVTVSSGGGGSGGGGSSGGGSEIVMTQSPATLSVSPGERVTLSCRASQSIGDYLYWYQQKSHESPRLLIKYASQSISGIPARFSGSGSGSEFTLTINSVEPEDVGVYYCQNGHSFPLTFGQGTKLELKR

SEQ ID NO: 37 - protein, 200 aa, Artificial Sequence
  source: /note="Description of Artificial Sequence: Synthetic scFv sequence"
QVQLVQSGAEVVKPGASVKLSCKTSGYTFTNYDINWVRQRPGQGLEWIGWIFPGDGSTQYNEKFKGKATLTTDTSTSTAYMELSSLRSEDTAVYFCARQTTATWFAYWGQGTLVTVSSGGGGSGGGGSGGGGSEIVMTQSPATLSVSPGERVTLSCRASQSISDYLYWYQQKSHESPRLLIKYASQSISGIPARFSGSGS

SEQ ID NO: 38 - protein, 241 aa, Artificial Sequence
  source: /note="Description of Artificial Sequence: Synthetic scFv sequence"
QVQLVQSGAEVVKPGASVKLSCKTSGYTFTNYDINWVRQRPGQGLEWIGWIFPGDGSTQYNEKFKGKATLTTDTSTSTAYMELSSLRSEDTAVYFCARQTTATWFAYWGQGTLVTVSSGGGGSGGGGSGGGGSEIVMTQSPATLSVSPGERVTLSCRASQSISDYLYWYQQKSHESPRLLIKYASQSISGIPARFSGSGSGSEFTLTINSVEPEDVGVYYCQNGHSFPLTFGQGTKLELKR

SEQ ID NO: 39 - protein, 200 aa, Artificial Sequence
  source: /note="Description of Artificial Sequence: Synthetic scFv sequence"
QVQLVQSGAEVVKPGASVKLSCKTSGYTFTNYDINWVRQRPGQGLEWIGWIFPGDGSTQYNEKFKGKATLTTDTSTSTAYMELSSLSSEDTAVYFCARQTTATWFAYWGQGTLVTVSSGGGGSGGGGSGGGGSEIVMTQSPATLSVSPGERVTLSCRASQEISDYLYWYQQKSHESPRLLIKYASQSISGIPARFSGSGS

SEQ ID NO: 40 - protein, 200 aa, Artificial Sequence
  source: /note="Description of Artificial Sequence: Synthetic scFv sequence"
QVQLVQSGAEVVKPGASVKLSCKTSGYTFTNYDINWVRQRPGQGLEWVGWIFPGDGSTQYNEKFKGKATLTTDTSTSTAYMELSSLRSEDTAVYFCARQTTSTWFAYWGQGTLVTVSSGGGGSGGGGSGGGGSEIVMTQSPATLSVSPGERVTLSCRASQEISDYLYWYQQKSHESPRLLIKYASQSISGIPARFSGSGS

SEQ ID NO: 41 - protein, 241 aa, Artificial Sequence
  source: /note="Description of Artificial Sequence: Synthetic scFv sequence"
QVQLVQSGAEVVKPGASVKLSCKTSGYTFTNYDINWVRQRPGQGLEWVGWIFPGDGSTQYNEKFKGKATLTTDTSTSTAYMELSSLRSEDTAVYFCARQTTSTWFAYWGQGTLVTVSSGGGGSGGGGSGGGGSEIVMTQSPATLSVSPGERVTLSCRASQPISDYLYWYQQKSHESPRLLIKYASQSISGIPARFSGSGSGSEFTLTINSVEPEDVGVYYCQNGYSFPLTFGQGTKLELKR

SEQ ID NO: 42 - protein, 241 aa, Artificial Sequence
  source: /note="Description of Artificial Sequence: Synthetic scFv sequence"
QVQLVQSGAEVVKPGASVKVSCKASGYTFTNYDINWVRQRPEQGLEWIGWIFPGDGSTQYNEKFKGRVTMTTDTSTSTVYMELSSLRSEDTAVYFCARQTTATWFAYWGQGTLVTVSSGGGGSGGGGSGGGGSEIVMTQSPATLSVSPGERVTLSCRASQSISDYLHWYQQKSHQAPRLLIKYASQSISGIPARFSGSGSGSEFTLTISSLQPEDFGVYYCQNGHSFPLTFGQGTKLELKR

SEQ ID NO: 43 - protein, 241 aa, Artificial Sequence
  source: /note="Description of Artificial Sequence: Synthetic scFv sequence"
QVQLVQSGAEVVKPGASVKVSCKTSGYTFTNYDINWVRQRPGQGLEWIGWIFPGDDSTQYNEKFKGRVTMTTDTSTSTVYMELSSLRSEDTAVYFCARQTTGTWFAYWGQGTLVTVSSGGGGSGGGGSGGGGSEIVMTQSPATLSVSPGERVTLSCRASQSISDYLYWYQQKSHQAPRLLIKYASQSISGIPARFSGSGSGSEFTLTISSLQPEDFGVYYCQNGHSFPLTFGQGTKLELKR

SEQ ID NO: 44 - protein, 200 aa, Artificial Sequence
  source: /note="Description of Artificial Sequence: Synthetic scFv sequence"
  MOD_RES (3)..(3): Any amino acid
QVXLVQSGAEVVKPGASVKLSCKASGYTFTNYDINWARQRPGQGLEWIGWIFPGDGSTQYNEKFKGKATLTTDTSTGTAYMELSSLRSEDTAVYFCARQTTATWFAYWGQGTVVTVSSGGGGSGGGGSGGGGNEIVMTQSPATLSVSPGERVTLSCRASQSISDYVYWYQQKPHESPRLLIKYASQSISGIPARFSGSGS

SEQ ID NO: 45 - protein, 200 aa, Artificial Sequence
  source: /note="Description of Artificial Sequence: Synthetic scFv sequence"
  MOD_RES (3)..(3): Any amino acid
QVXLVQSGAEVVKPGASVKLSCKTSGYTFTNYDINWVRQRPGQGLEWIGWIFPGDGSTQYNEKFKGKATLTTDTSTSTAYLELSSLGSEDTAVYFCARQTTGTWFAYWGQGTLVTVSSGGGGSGGGGSGGGGSEIVMTQSPATLSVSPGERVTLSCRASQSISDYLYWYQQKSHESPRLLIKYASQSISGIPARFSGSGS

SEQ ID NO: 46 - protein, 200 aa, Artificial Sequence
  source: /note="Description of Artificial Sequence: Synthetic scFv sequence"
  MOD_RES (3)..(3): Any amino acid
QVXLVQSGAEVVKPGASVKLSCKTSGYTFTNYDINWVRQRPGQGLEWIGWIFPGDGSTQYNEKFKGKATLTTDTSTSTAYMELSSLGSEDTAVYFCTRQTTATWFAYWGQGTLVTVSSGGGGSGGGGSSGGGSEIVMTQSPATLSVSPGERVTLSCRASQSIGDYLYWYQQKSHESPRLLIKYASQSISGIPARFSGSGS

SEQ ID NO: 47 - protein, 200 aa, Artificial Sequence
  source: /note="Description of Artificial Sequence: Synthetic scFv sequence"
  MOD_RES (3)..(3): Any amino acid
QVXLVQSGAEVVKPGASVKLSCKTSGYTFTNYDINWVRQRPGQGLEWIGWIFPGDGSTQYNEKFKGKATLTTDTSTSTAYMELSSLRSEDTAVYFCARQTTATWFAYWGQGTLVTVSSGGGGSGGGGSGGVGSEIVMTQSPATLSVSPGERVTLSCRASQSIGDYLYWYQQKSHESPRLLIKYASQSISGIPARFSGSGS

SEQ ID NO: 48 - protein, 200 aa, Artificial Sequence
  source: /note="Description of Artificial Sequence: Synthetic scFv sequence"
  MOD_RES (3)..(3): Any amino acid
  MOD_RES (5)..(5): Any amino acid
QVXLXQSGAEVVKPGASVKLSCKTSGYTFTNYDINWVRQRPGQGLEWIGWIFPGDGSTQYNEKFKGKATLTTDTSTSTAYLELSSLGSEDTAVYFCARQTTGTWFAYWGQGTLVTVSSGGGGSGGGGSGGGGSEIVMTQSPATLSVSPGERVTLSCRASQSISDYLYWYQQKSHESPRLLIKYASQSISGIPARFSGSGS

SEQ ID NO: 49 - protein, 200 aa, Artificial Sequence
  source: /note="Description of Artificial Sequence: Synthetic scFv sequence"
  MOD_RES (3)..(3): Any amino acid
  MOD_RES (5)..(5): Any amino acid
QVXLXQSGAEVVKPGASVKLSCKTSGYTFTNYDINWVRQRPGQGLEWIGWIFPGDGSTQYNEKFKGKATLTTDTSTSTAYMELSSLRSEDTAVYFCARQTTATWFAYWGQGTLVTVSSGGGGSGGGGSGGGGSEIVMTQSPATLSVSPGERVTLSCRASQSISDYLYWYQQKSHESPRLLIKYASQSISGIPARFSGSGS

SEQ ID NO: 50 - protein, 200 aa, Artificial Sequence
  source: /note="Description of Artificial Sequence: Synthetic scFv sequence"
  MOD_RES (3)..(4): Any amino acid
  MOD_RES (18)..(18): Any amino acid
QVXXVQSGAEVVKPGASXKLSCKTSGYTFTNYDINWVRQRPGQGLEWIGWIFPGDGSTQYNEKFKGKATLTTDTSTSTAYMELSSLRSEDTAVYFCARQTTATWFAYWGQGTLVTVSSGGGGSGGGGSGGVGSEIVMTQSPATLSVSPGERVTLSCRASQSIGDYLYWYQQKSHESPRLLIKYASQSISGIPARFSGSGS

SEQ ID NO: 51 - protein, 200 aa, Artificial Sequence
  source: /note="Description of Artificial Sequence: Synthetic scFv sequence"
  MOD_RES (3)..(5): Any amino acid
QVXXXQSGAEVVKPGASVKLSCKTSGYTFTNYDINWVRQRPGQGLEWIGWIFPGDDSTQYNEKFKGKATLTTDTSTSTAYMELSSLRSEDTAVYFCARQTTGTWFAYWGQGTLVTVSSGGGGSGGGGSGGGGSEIVMTQSPATLSVSPGERVTLSCRASQSISDYLYWYQQKSHESPRLLIKYASQSIPGIPARFSGSGS

SEQ ID NO: 52 - protein, 200 aa, Artificial Sequence
  source: /note="Description of Artificial Sequence: Synthetic scFv sequence"
  MOD_RES (3)..(5): Any amino acid
  MOD_RES (170)..(171): Any amino acid
QVXXXQSGAEVVKPGASVKLSCKTSGYTFTNYDINWVRQRPGQGLEWIGWIFPGDGSTQYNEKFKGKATLTTDTSTSTAYLELSSLGSEDTAVYFCARQTTGTWFAYWGQGTLVTVSSGGGGSGGGGSGGGGSEIVMTQSPATLSVSPGERVTLSCRASQSISDYLYWYXXKSHESPRLLIKYASQSISGIPARFSGSGS

SEQ ID NO: 53 - protein, 200 aa, Artificial Sequence
  source: /note="Description of Artificial Sequence: Synthetic scFv sequence"
  MOD_RES (2)..(5): Any amino acid
QXXXXQSGAEVVKPGASVKLSCKTSGYTFTNYDINWVRQRPGQGLEWIGWIFPGDGSTQYNEKFKGKATLTTDTSTSTAYMELSSLRSEDTAVYFCARQTTATWFAYWGQGTLVTVSSGGGGSGGGGSGGVGSEIVMTQSPATLSVSPGERVTLSCRASQSIGDYLYWYQQKSHESPRLLIKYASQSISGIPARFSGSGS

SEQ ID NO: 54 - protein, 200 aa, Artificial Sequence
  source: /note="Description of Artificial Sequence: Synthetic scFv sequence"
  MOD_RES (2)..(6): Any amino acid
  MOD_RES (17)..(19): Any amino acid
QXXXXXSGAEVVKPGAXXXLSCKTSGYTFTNYDINWVRQRPGQGLEWIGWIFPGDGSTQYNEKFKGKATLTTDTSTSTAYLELSSLGSEDTAVYFCARQTTGTWFAYWGQGTLVTVSSGGGGSGGGGSGGGGSEIVMTQSPATLSVSPGERVTLSCRASQSISDYLYWYQQKSHESPRLLIKYASQSISGIPARFSGSGS

SEQ ID NO: 55 - protein, 253 aa, Artificial Sequence
  source: /note="Description of Artificial Sequence: Synthetic scFv sequence"
DIVMTQTPATLSVSPGKRATLSCRASQSVSSNYLAWYQQKPGQAPRLLIYGASRRATGIPDRFSGSGSGTDFTLTISSLQAEDVAVYYCQQYGSSPRTFGQGTKLEIKGGSSRSSSSGGGGSGGGGQVTLKESGAEVKNPGSSVKVSCKASGGTFSSYAISWLRQAPGQGLEWMGWINPNSGGSDYAQRFQGRVTMTRDTSINTVYMELSRLRSDDTAVYYCARVEKRGYYYGMDVWGQGTMVTVSSFEGSEQ

SEQ ID NO: 56 - protein, 255 aa, Artificial Sequence
  source: /note="Description of Artificial Sequence: Synthetic scFv sequence"
QPGLTQPPSASGTPGQRVTISCSGSSSNIGSNYVYWYQQFPGTAPKLLIYRNNQRPSGVPDRFSGSKSGTSASLAISGLRSEDEADYYCAAWDDSLSVWVFGGGTKVTVLGGSSRSSSSGGSGSGGGGQVTLKESGAEVKNPGSSVKVSCKASGGTFSSYAISWLRQAPGQGLEWMGWINPNSGGSDYAQRFQGRVTMTRDTSINTVYMELSRLRSDDTAVYYCARVEKRGYYYGMDVWGQGTMVTVSSFEGSEQ

SEQ ID NO: 57 - protein, 263 aa, Artificial Sequence
  source: /note="Description of Artificial Sequence: Synthetic scFv sequence"
QPVLTQSHSVSESPGKTVTITCTGSGGNIATQYVQWYQQRPGSGPTTVIYDDDQRPSGVPDRFTGSIDSSSNSASLTISGLKTEDEADYYCQSYDSTNHGVFGGGAKVTVLGGSSRSSSSGGGGSGGGGQVQLQQWGPGLVKPSETLSLTCTVSGGSISSSSYYWGWIRQPPGKGLEWIGSIYYSGSTYYNPSLKSRVTISVDTSKNQFSLKLSSVTAADTAVYYCARLSKGYSSSWAYSYYGPDAWGQGTMVTVSSFEGSEQ

SEQ ID NO: 58 - protein, 263 aa, Artificial Sequence
  source: /note="Description of Artificial Sequence: Synthetic scFv sequence"
QPVLTQSHTVTITCTGYVQWYQQRSVSESPGKSGGNIATQPGSGPTTVIYDDDQRPSGVPDRFTGSIDSSSNSASLTISGLKTEDEADYYCQSYDSTNHGVFGGGAKVTVLGGSSRSSSSGGGGSGGGGQVQLQQWGPGLVKPSETLSLTCTVSGGSISSSSYYWGWIRQPPGKGLEWIGSIYYSGSTYYNPSLKSRVTISVDTSKNQFSLKLSSVTAADTAVYYCARLSKGYSSSWAYSYYGPDAWGQGTMVTVSSFEGSEQ

SEQ ID NO: 59 - protein, 254 aa, Artificial Sequence
  source: /note="Description of Artificial Sequence: Synthetic scFv sequence"
RPVLTQPPSAAGTPGQRVTISCSGSSSNIGSNYVYWYQQLPGMAPKLLIYTNNQRPSGVPGRFSGSKSGTSASLAISGLRSEDEADYYCAAWDDSLNGWVFGGGTELTVLGGSSRSSSSGGGGSGGGGQVQLQESGPGLVKPSETLSLTCNVSGRSVSSGFYWSWIRQRPGKGLEWVGSIYRSGLTYYNPSLKSRVTISVDTSKNQFSLKLSSVTAADTAVYYCARATPWYYYGMDVWGQGTTVTVSSFEGSEQ

SEQ ID NO: 60 - protein, 249 aa, Artificial Sequence
  source: /note="Description of Artificial Sequence: Synthetic scFv sequence"
DIQMTQSPSSLSASVGDRVTITCSASQDISNYLNWYQQKPGKAPKLLIYYTSNLHSGVPSRFSGSGSGTDFTLTISSLQPEDFATYYCQQYRKLPWTFGQGTKLEIKRGGGGSGGGGSGGGGSGGGGSQVQLVQSGAEVKKPGSSVKVSCKASGGTFSNYWMHWVRQAPGQGLEWMGATYRGHSDTYYNQKFKGRVTITADKSTSTAYMELSSLRSEDTAVYYCARGAIYNGYDVLDNWGQGTLVTVSS

SEQ ID NO: 61 - protein, 246 aa, Artificial Sequence
  source: /note="Description of Artificial Sequence: Synthetic scFv sequence"
DIVLTQSPASLAMSLGKRATISCRASESVSVIGAHLIHWYQQKPGQPPKLLIYLASNLETGVPARFSGSGSGTDFTLTIDPVEEDDVAIYSCLQSRIFPRTFGGGTKLEIKGSTSGSGKPGSGEGSTKGQIQLVQSGPELKKPGETVKISCKASGYTFTDYSINWVKRAPGKGLKWMGWINTETREPAYAYDFRGRFAFSLETSASTAYLQINNLKYEDTATYFCALDYSYAMDYWGQGTSVTVSS

SEQ ID NO: 62 - DNA, 738 bp, Artificial Sequence
  source: /note="Description of Artificial Sequence: Synthetic scFv sequence"
gacatcgtgctgacacagagccctgcatccctggcaatgtccctgggcaagagggcaaccatctcttgcagggcctctgagagcgtgtccgtgatcggcgcccacctgatccactggtaccagcagaagccaggacagccacctaagctgctgatctatctggcctccaacctggagacaggagtgcctgcacggttctctggcagcggctccggcaccgactttacactgaccatcgatccagtggaggaggacgatgtggccatctactcttgcctgcagagcagaatcttccccaggacatttggcggcggcaccaagctggagatcaagggctctacaagcggctccggcaagcctggctccggagagggctctaccaagggacagatccagctggtgcagtccggacccgagctgaagaagcctggcgagacagtgaagatcagctgtaaggcctccggctacacattcaccgattattctatcaactgggtgaagagggcaccaggcaagggcctgaagtggatgggctggatcaatacagagacacgggagcccgcctacgcctatgacttcagaggcaggttcgcctttagcctggagacatctgccagcaccgcctacctgcagatcaacaatctgaagtacgaggatacagccacctatttttgcgccctggactacagctatgccatggattattggggccagggcacatccgtgaccgtgagctcc

SEQ ID NO: 63 - protein, 238 aa, Artificial Sequence
  source: /note="Description of Artificial Sequence: Synthetic scFv sequence"
EVQLLETGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSSASGGGGSGGRASGGGGSEIVLTQSPATLSVSPGESATLSCRASQSVSSNLAWYQQKPGQAPRLLIYGASTRASGIPDRFSGSGSGTDFTLTISSLQAEDVAVYYCQQYGSSLTFGGGTKVEIK

SEQ ID NO: 64 - protein, 240 aa, Artificial Sequence
  source: /note="Description of Artificial Sequence: Synthetic scFv sequence"
EVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDLRGAFDIWGQGTMVTVSSGGGGSGGGGSGGGGSSYVLTQSPSVSAAPGYTATISCGGNNIGTKSVHWYQQKPGQAPLLVIRDDSVRPSKIPGRFSGSNSGNMATLTISGVQAGDEADFYCQVWDSDSEHVVFGGGTKLTVL

SEQ ID NO: 65 - protein, 241 aa, Artificial Sequence
  source: /note="Description of Artificial Sequence: Synthetic scFv sequence"
EVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCAKVVRDGMDVWGQGTTVTVSSGGGGSGGGGSGGGGSEIVLTQSPATLSLSPGERATLSCRASQSVSSSYLAWYQQKPGQAPRLLIYGASSRATGIPDRFSGNGSGTDFTLTISRLEPEDFAVYYCQQYGSPPRFTFGPGTKVDIK

SEQ ID NO: 66 - protein, 106 aa, Artificial Sequence
  source: /note="Description of Artificial Sequence: Synthetic scFv sequence"
EVQLVESGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWG

SEQ ID NO: 67 - protein, 239 aa, Artificial Sequence
  source: /note="Description of Artificial Sequence: Synthetic scFv sequence"
EVQLVESGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSSASGGGGSGGRASGGGGSDIQLTQSPSSLSASVGDRVTITCRASQSISSYLNWYQQKPGKAPKLLIYAASSLQSGVPSRFSGSGSGTDFTLTISSLQPEDFATYYCQQSYSTPYTFGQGTKVEIK

SEQ ID NO: 68 - protein, 241 aa, Artificial Sequence
  source: /note="Description of Artificial Sequence: Synthetic scFv sequence"
EVQLVESGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSSASGGGGSGGRASGGGGSEIVLTQSPGTLSLSPGERATLSCRASQSIGSSSLAWYQQKPGQAPRLLMYGASSRASGIPDRFSGSGSGTDFTLTISRLEPEDFAVYYCQQYAGSPPFTFGQGTKVEIK

SEQ ID NO: 69 - protein, 238 aa, Artificial Sequence
  source: /note="Description of Artificial Sequence: Synthetic scFv sequence"
EVQLVESGGGLVQPGGSLRLSCAVSGFALSNHGMSWVRRAPGKGLEWVSGIVYSGSTYYAASVKRFTISRDNSRNTLYLQMNSLRPEDTAIYYCSAHGGESDVWGQGTTVTVSSASGGGGSGGRASGGGGSDIQLTQSPSSLSASVGDRVTITCRASQSISSYLNWYQQKPGKAPKLLIYAASSLQSGVPSRFSGSGSGTDFTLTISSLQPEDFATYYCQQSYSTPYTFGQGTKVEIK

SEQ ID NO: 70 - protein, 248 aa, Artificial Sequence
  source: /note="Description of Artificial Sequence: Synthetic scFv sequence"
EVQLVETGGGLVQPGGSLRLSCAASGFTFSSYAMSWVRQAPGKGLEWVSAISGSGGSTYYADSVKGRFTISRDNSKNTLYLQMNTLKAEDTAVYYCARATYKRELRYYYGMDVWGQGTTVTVSSGGGGSGGGGSGGGGSEIVLTQSPSTLSLSPGESATLSCRASQSVSTTFLAWYQQKPGQAPRLLIYGSSNRATGIPDRFSGSGSGTDFTLTIRRLEFEDFAVYYCQQYHSSPSWTFGQGTKVEIK

SEQ ID NO: 71 - protein, 248 aa, Artificial Sequence
  source: /note="Description of Artificial Sequence: Synthetic scFv sequence"
EVQLVETGGGLVQPGGSLRLSCAASGFTFSSYAMSWVRQAPGKGLEWVSAISGSGGSTYYADSVKGRFTMSRENDKNSVFLQMNSLRVEDTGVYYCARANYKRELRYYYGMDVWGQGTMVTVSSGGGGSGGGGSGGGGSEIVMTQSPGTLSLSPGESATLSCRASQRVASNYLAWYQHKPGQAPSLLISGASSRATGVPDRFSGSGSGTDFTLAISRLEPEDSAVYYCQHYDSSPSWTFGQGTKVEIK

SEQ ID NO: 72 - protein, 241 aa, Artificial Sequence
  source: /note="Description of Artificial Sequence: Synthetic scFv sequence"
EVQLVETGGGLVQPGGSLRLSCAASGITFSRYPMSWVRQAPGKGLEWVSGISDSGVSTYYADSAKGRFTISRDNSKNTLFLQMSSLRDEDTAVYYCVTRAGSEASDIWGQGTMVTVSSGGGGSGGGGSGGGGSEIVLTQSPATLSLSPGERATLSCRASQSVSNSLAWYQQKPGQAPRLLIYDASSRATGIPDRFSGSGSGTDFTLTISRLEPEDFAIYYCQQFGTSSGLTFGGGTKLEIK

SEQ ID NO: 73 - protein, 239 aa, Artificial Sequence
  source: /note="Description of Artificial Sequence: Synthetic scFv sequence"
EVQLVETGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSSASGGGGSGGRASGGGGSEIVMTQSPATLSVSPGERATLSCRASQSVSSKLAWYQQKPGQAPRLLMYGASIRATGIPDRFSGSGSGTEFTLTISSLEPEDFAVYYCQQYGSSSWTFGQGTKVEIK

SEQ ID NO: 74 - protein, 240 aa, Artificial Sequence
  source: /note="Description of Artificial Sequence: Synthetic scFv sequence"
EVQLVETGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSSASGGGGSGGRASGGGGSETTLTQSPATLSVSPGERATLSCRASQSVGSNLAWYQQKPGQGPRLLIYGASTRATGIPARFSGSGSGTEFTLTISSLQPEDFAVYYCQQYNDWLPVTFGQGTKVEIK

SEQ ID NO: 75 - protein, 238 aa, Artificial Sequence
  source: /note="Description of Artificial Sequence: Synthetic scFv sequence"
EVQLVETGGGLVQPGRSLRLSCAASGFTFDDYAMHWVRQAPGKGLEWVSGISWNSGSIGYADSVGRFTISRDNAKNSLYLQMNSLRDEDTAVYYCARVGKAVPDVWGQGTTVTVSSGGGGSGGGGSGGGGSDIVMTQTPSSLSASVGDRVTITCRASQSISSYLNWYQQKPGKAPKLLIYAASSLQSGVPSRFSGSGSGTDFTLTISSLQPEDFATYYCQQSYSTPYSFGQGTRLEIK

SEQ ID NO: 76 - protein, 239 aa, Artificial Sequence
  source: /note="Description of Artificial Sequence: Synthetic scFv sequence"
EVQLVETGGGLVQPGRSLRLSCAASGFTFDDYAMHWVRQAPGKGLEWVSGISWNSGSIGYADSVKGRFTISRDNAKNSLYLQMNSLRDEDTAVYYCARVGKAVPDVWGQGTTVTVSSGGGGSGGGGSGGGGSDIVMTQTPSSLSASVGDRVTITCRASQSISSYLNWYQQKPGKAPKLLIYAASSLQSGVPSRFSGSGSGTDFTLTISSLQPEDFATYYCQQSYSTPYSFGQGTRLEIK

SEQ ID NO: 77 - protein, 241 aa, Artificial Sequence
  source: /note="Description of Artificial Sequence: Synthetic scFv sequence"
EVQLVETGGGVVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSSASGGGGSGGRASGGGGSEIVLTQSPGTLSLSPGERATLSCRASQSVGSTNLAWYQQKPGQAPRLLIYDASNRATGIPDRFSGGGSGTDFTLTISRLEPEDFAVYYCQQYGSSPPWTFGQGTKVEIK

SEQ ID NO: 78 - protein, 239 aa, Artificial Sequence
  source: /note="Description of Artificial Sequence: Synthetic scFv sequence"
QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARESGDGMDVWGQGTTVTVSSASGGGGSGGRASGGGGSDIQMTQSPSSLSASVGDRVTITCRASQSISSYLNWYQQKPGKAPKLLIYAASSLQSGVPSRFSGSGSGTDFTLTISSLQPEDFATYYCQQSYTLAFGQGTKVDIK

SEQ ID NO: 79 - protein, 248 aa, Artificial Sequence
  source: /note="Description of Artificial Sequence: Synthetic scFv sequence"
QVQLVESGGGLVQPGGSLRLSCAASGFTFSSYAMSWVRQAPGKGLEWVSAISGSGGSTYYADSVKGRFTISRDNAKNSLYLQMNSLRAEDTAIYYCARATYKRELRYYYGMDVWGQGTMVTVSSGGGGSGGGGSGGGGSEIVMTQSPGTVSLSPGERATLSCRASQSVSSSFLAWYQQKPGQAPRLLIYGASSRATGIPDRFSGSGSGTDFTLTISRLEFEDSAVYYCQQYHSSPSWTFGQGTRLEIK

SEQ ID NO: 80 - protein, 251 aa, Artificial Sequence
  source: /note="Description of Artificial Sequence: Synthetic scFv sequence"
QVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCAKVGYDSSGYYRDYYGMDVWGQGTTVTVSSGGGGSGGGGSGGGGSEIVLTQSPGTLSLSPGERATLSCRASQSVSSSYLAWYQQKPGQAPRLLIYGTSSRATGISDRFSGSGSGTDFTLTISRLEPEDFAVYYCQHYGNSPPKFTFGPGTKLEIK

SEQ ID NO: 81 - protein, 250 aa, Artificial Sequence
  source: /note="Description of Artificial Sequence: Synthetic scFv sequence"
QVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCAKVGYDSSGYYRDYYGMDVWGQGTTVTVSSGGGGSGGGGSGGGGSEIVLTQSPGTLSLSPGERATLSCRASQSVSSSYLAWYQQKPGQAPRLLIYTSSRATGISDRFSGSGSGTDFTLTISRLEPEDFAVYYCQHYGNSPPKFTFGPGTKLEIK

SEQ ID NO: 82 - protein, 239 aa, Artificial Sequence
  source: /note="Description of Artificial Sequence: Synthetic scFv sequence"
QVQLVESGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSSASGGGGSGGRASGGGGSDIRLTQSPSPLSASVGDRVTITCQASEDINKFLNWYHQTPGKAPKLLIYDASTLQTGVPSRFSGSGSGTDFTLTINSLQPEDIGTYYCQQYESLPLTFGGGTKVEIK

SEQ ID NO: 83 - protein, 247 aa, Artificial Sequence
  source: /note="Description of Artificial Sequence: Synthetic scFv sequence"
QVQLVQSGAEVKKPGASVKVSCKASGYTFSNYGITWVRQAPGQGLEWMGWISAYNGNTNYAQKFQGRVTMTRNTSISTAYMELSSLRSEDTAVYYCARGPYYYYMDVWGKGTMVTVSSASGGGGSGGRASGGGGSEIVMTQSPLSLPVTPGEPASISCRSSQSLLYSNGYNYVDWYLQKPGQSPQLLIYLGSNRASGVPDRFSGSGSGTDFKLQISRVEAEDVGIYYCMQGRQFPYSFGQGTKVEIK

SEQ ID NO: 84 - protein, 241 aa, Artificial Sequence
  source: /note="Description of Artificial Sequence: Synthetic scFv sequence"
QVQLVQSGAEVKKPGASVKVSCKPSGYTVTSHYIHWVRRAPGQGLEWMGMINPSGGVTAYSQTLQGRVTMTSDTSSSTVYMELSSLRSEDTAMYYCAREGSGSGWYFDFWGRGTLVTVSSGGGGSGGGGSGGGGSSYVLTQPPSVSVSPGQTASITCSGDGLSKKYVSWYQQKAGQSPVVLISRDKERPSGIPDRFSGSNSADTATLTISGTQAMDEADYYCQAWDDTTVVFGGGTKLTVL

SEQ ID NO: 85 - protein, 249 aa, Artificial Sequence
  source: /note="Description of Artificial Sequence: Synthetic scFv sequence"
QVQLVQSGAEVKKPGSSVKVSCKASGGTFSNYWMHWVRQAPGQGLEWMGATYRGHSDTYYNQKFKGRVTITADKSTSTAYMELSSLRSEDTAVYYCARGAIYNGYDVLDNWGQGTLVTVSSGGGGSGGGGSGGGGSGGGGSDIQMTQSPSSLSASVGDRVTITCSASQDISNYLNWYQQKPGKAPKLLIYYTSNLHSGVPSRFSGSGSGTDFTLTISSLQPEDFATYYCQQYRKLPWTFGQGTKLEIKR

SEQ ID NO: 86 - protein, 248 aa, Artificial Sequence
  source: /note="Description of Artificial Sequence: Synthetic scFv sequence"
QVQLVQSGAEVRKTGASVKVSCKASGYIFDNFGINWVRQAPGQGLEWMGWINPKNNNTNYAQKFQGRVTITADESTNTAYMEVSSLRSEDTAVYYCARGPYYYQSYMDVWGQGTMVTVSSASGGGGSGGRASGGGGSDIVMTQTPLSLPVTPGEPASISCRSSQSLLHSNGYNYLNWYLQKPGQSPQLLIYGSKRASGVPDRFSGSGSGTDFTLHITRVGAEDVGVYYCMQALQTPYTFGQGTKLEIK

SEQ ID NO: 87 - protein, 244 aa, Artificial Sequence
  source: /note="Description of Artificial Sequence: Synthetic scFv sequence"
VNLRESGPALVKPTQTLTLTCTFSGFSLRTSGMCVSWIRQPPGKALEWLARIDWDEDKFYSTSLKTRLTISKDTSDNQVVLRMTNMDPADTATYYCARSGAGGTSATAFDIWGPGTMVTVSSGGGGSGGGGSGGGGSDIQMTQSPSSLSASVGDRVTITCRASQDIYNNLAWFQLKPGSAPRSLMYAANKSQSGVPSRFSGSASGTDFTLTISSLQPEDFATYYCQHYYRFPYSFGQGTKLEIK

SEQ ID NO: 88 - DNA, 747 bp, Artificial Sequence
  source: /note="Description of Artificial Sequence: Synthetic scFv sequence"
caagtccaactcgtccagtccggcgcagaagtcagaaaaaccggtgctagcgtgaaagtgtcctgcaaggcctccggctacattttcgataacttcggaatcaactgggtcagacaggccccgggccaggggctggaatggatgggatggatcaaccccaagaacaacaacaccaactacgcacagaagttccagggccgcgtgactatcaccgccgatgaatcgaccaataccgcctacatggaggtgtcctccctgcggtcggaggacactgccgtgtattactgcgcgaggggcccatactactaccaaagctacatggacgtctggggacagggaaccatggtgaccgtgtcatccgcctccggtggtggaggctccggggggcgggcttcaggaggcggaggaagcgatattgtgatgacccagactccgcttagcctgcccgtgactcctggagaaccggcctccatttcctgccggtcctcgcaatcactcctgcattccaacggttacaactacctgaattggtacctccagaagcctggccagtcgccccagttgctgatctatctgggctcgaagcgcgcctccggggtgcctgaccggtttagcggatctgggagcggcacggacttcactctccacatcacccgcgtgggagcggaggacgtgggagtgtactactgtatgcaggcgctgcagactccgtacacattcggacagggcaccaagctggagatcaag

SEQ ID NO: 89 - DNA, 738 bp, Artificial Sequence
  source: /note="Description of Artificial Sequence: Synthetic scFv sequence"
caagtgcaacttcaagaatcaggcggaggactcgtgcagcccggaggatcattgcggctctcgtgcgccgcctcgggcttcaccttctcgagcgacgccatgacctgggtccgccaggccccggggaaggggctggaatgggtgtctgtgatttccggctccgggggaactacgtactacgccgattccgtgaaaggtcgcttcactatctcccgggacaacagcaagaacaccctttatctgcaaatgaattccctccgcgccgaggacaccgccgtgtactactgcgccaagctggactcctcgggctactactatgcccggggtccgagatactggggacagggaaccctcgtgaccgtgtcctccgcgtccggcggaggagggtcgggagggcgggcctccggcggcggcggttcggacatccagctgacccagtccccatcctcactgagcgcaagcgtgggcgacagagtcaccattacatgcagggcgtcccagagcatcagctcctacctgaactggtaccaacagaagcctggaaaggctcctaagctgttgatctacggggcttcgaccctggcatccggggtgcccgcgaggtttagcggaagcggtagcggcactcacttcactctgaccattaacagcctccagtccgaggattcagccacttactactgtcagcagtcctacaagcgggccagcttcggacagggcactaaggtcgagatcaag

SEQ ID NO: 90 - DNA, 741 bp, Artificial Sequence
  source: /note="Description of Artificial Sequence: Synthetic scFv sequence"
caagtccaactggtccagagcggtgcagaagtgaagaagcccggagcgagcgtgaaagtgtcctgcaaggcttccgggtacaccttctccaactacggcatcacttgggtgcgccaggccccgggacagggcctggaatggatggggtggatttccgcgtacaacggcaatacgaactacgctcagaagttccagggtagagtgaccatgactaggaacacctccatttccaccgcctacatggaactgtcctccctgcggagcgaggacaccgccgtgtactattgcgcccggggaccatactactactacatggatgtctgggggaaggggactatggtcaccgtgtcatccgcctcgggaggcggcggatcaggaggacgcgcctctggtggtggaggatcggagatcgtgatgacccagagccctctctccttgcccgtgactcctggggagcccgcatccatttcatgccggagctcccagtcacttctctactccaacggctataactacgtggattggtacctccaaaagccgggccagagcccgcagctgctgatctacctgggctcgaacagggccagcggagtgcctgaccggttctccgggtcgggaagcgggaccgacttcaagctgcaaatctcgagagtggaggccgaggacgtgggaatctactactgtatgcagggccgccagtttccgtactcgttcggacagggcaccaaagtggaaatcaag

SEQ ID NO: 91 - protein, 246 aa, Artificial Sequence
  source: /note="Description of Artificial Sequence: Synthetic scFv sequence"
QVQLVQSGAEVKKPGASVKVSCKASGYTFSNYGITWVRQAPGQGLEWMGWISAYNGNTNYAQKFQGRVTMTRNTSISTAYMELSSLRSEDTAVYYCARGPYYYYMDVWGKGTMVTVSSASGGGGSGGRASGGGGSEIVMTQSPLSLPVTPGEPASISCRSSQSLLYSNGYNYVDWYLQKPGQSPQLLIYLGSNRASGVPDRFSGSGSGTDFKLQISRVEAEDVGIYYCMQGRQFPYSFGQGTKVEI

SEQ ID NO: 92 - DNA, 738 bp, Artificial Sequence
  source: /note="Description of Artificial Sequence: Synthetic scFv sequence"
caagtgcaactcgtggaatctggtggaggactcgtgcaacccggaagatcgcttagactgtcgtgtgccgccagcgggttcactttctcgaactacgcgatgtcctgggtccgccaggcacccggaaagggactcggttgggtgtccggcatttcccggtccggcgaaaatacctactacgccgactccgtgaagggccgcttcaccatctcaagggacaacagcaaaaacaccctgtacttgcaaatgaactccctgcgggatgaagatacagccgtgtactattgcgcccggtcgcctgcccattactacggcggaatggacgtctggggacagggaaccactgtgactgtcagcagcgcgtcgggtggcggcggctcagggggtcgggcctccggggggggagggtccgacatcgtgctgacccagtccccgggaaccctgagcctgagcccgggagagcgcgcgaccctgtcatgccgggcatcccagagcattagctcctcctttctcgcctggtatcagcagaagcccggacaggccccgaggctgctgatctacggcgctagcagaagggctaccggaatcccagaccggttctccggctccggttccgggaccgatttcacccttactatctcgcgcctggaacctgaggactccgccgtctactactgccagcagtaccactcatccccgtcgtggacgttcggacagggcaccaagctggagattaag

SEQ ID NO: 93 - DNA, 714 bp, Artificial Sequence
  source: /note="Description of Artificial Sequence: Synthetic scFv sequence"
gaagtgcaattgctcgaaactggaggaggtctggtgcaacctggaggatcacttcgcctgtcctgcgccgtgtcgggctttgccctgtccaaccatggaatgagctgggtccgccgcgcgccggggaagggcctcgaatgggtgtccggcatcgtctactccggctccacctactacgccgcgtccgtgaagggccggttcacgatttcacgggacaactcgcggaacaccctgtacctccaaatgaattcccttcggccggaggatactgccatctactactgctccgcccacggtggcgaatccgacgtctggggccagggaaccaccgtgaccgtgtccagcgcgtccgggggaggaggaagcgggggtagagcatcgggtggaggcggatcagagatcgtgctgacccagtcccccgccaccttgagcgtgtcaccaggagagtccgccaccctgtcatgccgcgccagccagtccgtgtcctccaacctggcttggtaccagcagaagccggggcaggcccctagactcctgatctatggggcgtcgacccgggcatctggaattcccgataggttcagcggatcgggctcgggcactgacttcactctgaccatctcctcgctgcaagccgaggacgtggctgtgtactactgtcagcagtacggaagctccctgactttcggtggcgggaccaaagtcgagattaag

SEQ ID NO: 94 - DNA, 732 bp, Artificial Sequence
  source: /note="Description of Artificial Sequence: Synthetic scFv sequence"
caagtgcaactcgtcgaatccggtggaggtctggtccaacctggtagaagcctgagactgtcgtgtgcggccagcggattcacctttgatgactatgctatgcactgggtgcggcaggccccaggaaagggcctggaatgggtgtcgggaattagctggaactccgggtccattggctacgccgactccgtgaagggccgcttcaccatctcccgcgacaacgcaaagaactccctgtacttgcaaatgaactcgctcagggctgaggataccgcgctgtactactgctccgtgcattccttcctggcctactggggacagggaactctggtcaccgtgtcgagcgcctccggcggcgggggctcgggtggacgggcctcgggcggaggggggtccgacatcgtgatgacccagaccccgctgagcttgcccgtgactcccggagagcctgcatccatctcctgccggtcatcccagtcccttctccactccaacggatacaactacctcgactggtacctccagaagccgggacagagccctcagcttctgatctacctggggtcaaatagagcctcaggagtgccggatcggttcagcggatctggttcgggaactgatttcactctgaagatttcccgcgtggaagccgaggacgtgggcgtctactactgtatgcaggcgctgcagaccccctataccttcggccaagggacgaaagtggagatcaag

SEQ ID NO: 95 - DNA, 717 bp, Artificial Sequence
  source: /note="Description of Artificial Sequence: Synthetic scFv sequence"
gaagtgcaattggtggaaactggaggaggacttgtgcaacctggaggatcattgagactgagctgcgcagtgtcgggattcgccctgagcaaccatggaatgtcctgggtcagaagggcccctggaaaaggcctcgaatgggtgtcagggatcgtgtactccggttccacttactacgccgcctccgtgaaggggcgcttcactatctcacgggataactcccgcaataccctgtacctccaaatgaacagcctgcggccggaggataccgccatctactactgttccgcccacggtggagagtctgacgtctggggccagggaactaccgtgaccgtgtcctccgcgtccggcggtggagggagcggcggccgcgccagcggcggcggaggctccgagatcgtgatgacccagagccccgctactctgtcggtgtcgcccggagaaagggcgaccctgtcctgccgggcgtcgcagtccgtgagcagcaagctggcttggtaccagcagaagccgggccaggcaccacgcctgcttatgtacggtgcctccattcgggccaccggaatcccggaccggttctcggggtcggggtccggtaccgagttcacactgaccatttcctcgctcgagcccgaggactttgccgtctattactgccagcagtacggctcctcctcatggacgttcggccaggggaccaaggtcgaaatcaag

SEQ ID NO: 96 - DNA, 723 bp, Artificial Sequence
  source: /note="Description of Artificial Sequence: Synthetic scFv sequence"
gaagtgcaattggtggagactggaggaggagtggtgcaacctggaggaagcctgagactgtcatgcgcggtgtcgggcttcgccctctccaaccacggaatgtcctgggtccgccgggcccctgggaaaggacttgaatgggtgtccggcatcgtgtactcgggttccacctactacgcggcctcagtgaagggccggtttactattagccgcgacaactccagaaacacactgtacctccaaatgaactcgctgcggccggaagataccgctatctactactgctccgcccatgggggagagtcggacgtctggggacagggcaccactgtcactgtgtccagcgcttccggcggtggtggaagcgggggacgggcctcaggaggcggtggcagcgagattgtgctgacccagtcccccgggaccctgagcctgtccccgggagaaagggccaccctctcctgtcgggcatcccagtccgtggggtctactaaccttgcatggtaccagcagaagcccggccaggcccctcgcctgctgatctacgacgcgtccaatagagccaccggcatcccggatcgcttcagcggaggcggatcgggcaccgacttcaccctcaccatttcaaggctggaaccggaggacttcgccgtgtactactgccagcagtatggttcgtccccaccctggacgttcggccaggggactaaggtcgagatcaag

SEQ ID NO: 97 - DNA, 717 bp, Artificial Sequence
  source: /note="Description of Artificial Sequence: Synthetic scFv sequence"
caagtgcaactcgtggaatctggtggaggactcgtgaaacctggaggatcattgagactgtcatgcgcggcctcgggattcacgttctccgattactacatgagctggattcgccaggctccggggaagggactggaatgggtgtcctacatttcctcatccggctccaccatctactacgcggactccgtgaaggggagattcaccattagccgcgataacgccaagaacagcctgtaccttcagatgaactccctgcgggctgaagatactgccgtctactactgcgcaagggagagcggagatgggatggacgtctggggacagggtaccactgtgaccgtgtcgtcggcctccggcggagggggttcgggtggaagggccagcggcggcggaggcagcgacatccagatgacccagtccccctcatcgctgtccgcctccgtgggcgaccgcgtcaccatcacatgccgggcctcacagtcgatctcctcctacctcaattggtatcagcagaagcccggaaaggcccctaagcttctgatctacgcagcgtcctccctgcaatccggggtcccatctcggttctccggctcgggcagcggtaccgacttcactctgaccatctcgagcctgcagccggaggacttcgccacttactactgtcagcaaagctacaccctcgcgtttggccagggcaccaaagtggacatcaag

SEQ ID NO: 98 - DNA, 738 bp, Artificial Sequence
  source: /note="Description of Artificial Sequence: Synthetic scFv sequence"
caagtgcaactggtgcaaagcggaggaggattggtcaaacccggaggaagcctgagactgtcatgcgcggcctctggattcaccttctccgattactacatgtcatggatcagacaggccccggggaagggcctcgaatgggtgtcctacatctcgtcctccgggaacaccatctactacgccgacagcgtgaagggccgctttaccatttcccgcgacaacgcaaagaactcgctgtaccttcagatgaattccctgcgggctgaagataccgcggtgtactattgcgcccggtccactatggtccgggaggactactggggacagggcacactcgtgaccgtgtccagcgcgagcgggggtggaggcagcggtggacgcgcctccggcggcggcggttcagacatcgtgctgactcagtcgcccctgtcgctgccggtcaccctgggccaaccggcctcaattagctgcaagtcctcggagagcctggtgcacaactcaggaaagacttacctgaactggttccatcagcggcctggacagtccccacggaggctcatctatgaagtgtccaacagggattcgggggtgcccgaccgcttcactggctccgggtccggcaccgacttcaccttgaaaatctccagagtggaagccgaggacgtgggcgtgtactactgtatgcagggtacccactggcctggaacctttggacaaggaactaagctcgagattaag

SEQ ID NO: 99 - DNA, 729 bp, Artificial Sequence
  source: /note="Description of Artificial Sequence: Synthetic scFv sequence"
gaagtgcaattgttggaatctggaggaggacttgtgcagcctggaggatcactgagactttcgtgtgcggtgtcaggcttcgccctgagcaaccacggcatgagctgggtgcggagagccccggggaagggtctggaatgggtgtccgggatcgtctactccggttcaacttactacgccgcaagcgtgaagggtcgcttcaccatttcccgcgataactcccggaacaccctgtacctccaaatgaactccctgcggcccgaggacaccgccatctactactgttccgcgcatggaggagagtccgatgtctggggacagggcactaccgtgaccgtgtcgagcgcctcggggggaggaggctccggcggtcgcgcctccggggggggtggcagcgacattgtgatgacgcagactccactctcgctgtccgtgaccccgggacagcccgcgtccatctcgtgcaagagctcccagagcctgctgaggaacgacggaaagactcctctgtattggtacctccagaaggctggacagcccccgcaactgctcatctacgaagtgtcaaatcgcttctccggggtgccggatcggttttccggctcgggatcgggcaccgacttcaccctgaaaatctccagggtcgaggccgaggacgtgggagcctactactgcatgcaaaacatccagttcccttccttcggcggcggcacaaagctggagattaag

SEQ ID NO: 100 - DNA, 717 bp, Artificial Sequence
  source: /note="Description of Artificial Sequence: Synthetic scFv sequence"
caagtgcaactcgtggaatctggtggaggactcgtgcaacccggtggaagccttaggctgtcgtgcgccgtcagcgggtttgctctgagcaaccatggaatgtcctgggtccgccgggcaccgggaaaagggctggaatgggtgtccggcatcgtgtacagcgggtcaacctattacgccgcgtccgtgaagggcagattcactatctcaagagacaacagccggaacaccctgtacttgcaaatgaattccctgcgccccgaggacaccgccatctactactgctccgcccacggaggagagtcggacgtgtggggccagggaacgactgtgactgtgtccagcgcatcaggagggggtggttcgggcggccgggcctcggggggaggaggttccgacattcggctgacccagtccccgtccccactgtcggcctccgtcggcgaccgcgtgaccatcacttgtcaggcgtccgaggacattaacaagttcctgaactggtaccaccagacccctggaaaggcccccaagctgctgatctacgatgcctcgacccttcaaactggagtgcctagccggttctccgggtccggctccggcactgatttcactctgaccatcaactcattgcagccggaagatatcgggacctactattgccagcagtacgaatccctcccgctcacattcggcgggggaaccaaggtcgagattaag

SEQ ID NO: 101 - DNA, 720 bp, Artificial Sequence
  source: /note="Description of Artificial Sequence: Synthetic scFv sequence"
gaagtgcaattggtggaaactggaggaggacttgtgcaacctggaggatcattgcggctctcatgcgctgtctccggcttcgccctgtcaaatcacgggatgtcgtgggtcagacgggccccgggaaagggtctggaatgggtgtcggggattgtgtacagcggctccacctactacgccgcttcggtcaagggccgcttcactatttcacgggacaacagccgcaacaccctctatctgcaaatgaactctctccgcccggaggataccgccatctactactgctccgcacacggcggcgaatccgacgtgtggggacagggaaccactgtcaccgtgtcgtccgcatccggtggcggaggatcgggtggccgggcctccgggggcggcggcagcgagactaccctgacccagtcccctgccactctgtccgtgagcccgggagagagagccacccttagctgccgggccagccagagcgtgggctccaacctggcctggtaccagcagaagccaggacagggtcccaggctgctgatctacggagcctccactcgcgcgaccggcatccccgcgaggttctccgggtcgggttccgggaccgagttcaccctgaccatctcctccctccaaccggaggacttcgcggtgtactactgtcagcagtacaacgattggctgcccgtgacatttggacaggggacgaaggtggaaatcaaa

SEQ ID NO: 102 - DNA, 723 bp, Artificial Sequence
  source: /note="Description of Artificial Sequence: Synthetic scFv sequence"
gaagtgcaattggtggaatctggtggaggacttgtgcaacctggaggatcactgagactgtcatgcgcggtgtccggttttgccctgagcaatcatgggatgtcgtgggtccggcgcgcccccggaaagggtctggaatgggtgtcgggtatcgtctactccgggagcacttactacgccgcgagcgtgaagggccgcttcaccatttcccgcgataactcccgcaacaccctgtacttgcaaatgaactcgctccggcctgaggacactgccatctactactgctccgcacacggaggagaatccgacgtgtggggccagggaactaccgtgaccgtcagcagcgcctccggcggcgggggctcaggcggacgggctagcggcggcggtggctccgagatcgtgctgacccagtcgcctggcactctctcgctgagccccggggaaagggcaaccctgtcctgtcgggccagccagtccattggatcatcctccctcgcctggtatcagcagaaaccgggacaggctccgcggctgcttatgtatggggccagctcaagagcctccggcattcccgaccggttctccgggtccggttccggcaccgatttcaccctgactatctcgaggctggagccagaggacttcgccgtgtactactgccagcagtacgcggggtccccgccgttcacgttcggacagggaaccaaggtcgagatcaag

SEQ ID NO: 103 - DNA, 729 bp, Artificial Sequence
  source: /note="Description of Artificial Sequence: Synthetic scFv sequence"
caagtgcagcttcaggaaagcggaccgggcctggtcaagccatccgaaactctctccctgacttgcactgtgtctggcggttccatctcatcgtcgtactactactggggctggattaggcagccgcccggaaagggactggagtggatcggaagcatctactattccggctcggcgtactacaaccctagcctcaagtcgagagtgaccatctccgtggatacctccaagaaccagttttccctgcgcctgagctccgtgaccgccgctgacaccgccgtgtactactgtgctcggcattggcaggaatggcccgatgccttcgacatttggggccagggcactatggtcactgtgtcatccgggggtggaggcagcgggggaggagggtccggggggggaggttcagagacaaccttgacccagtcacccgcattcatgtccgccactccgggagacaaggtcatcatctcgtgcaaagcgtcccaggatatcgacgatgccatgaattggtaccagcagaagcctggcgaagcgccgctgttcattatccaatccgcaacctcgcccgtgcctggaatcccaccgcggttcagcggcagcggtttcggaaccgacttttccctgaccattaacaacattgagtccgaggacgccgcctactacttctgcctgcaacacgacaacttccctctcacgttcggccagggaaccaagctggaaatcaag

SEQ ID NO: 104 - DNA, 735 bp, Artificial Sequence
  source: /note="Description of Artificial Sequence: Synthetic scFv sequence"
caagtcaatctgcgcgaatccggccccgccttggtcaagcctacccagaccctcactctgacctgtactttctccggcttctccctgcggacttccgggatgtgcgtgtcctggatcagacagcctccgggaaaggccctggagtggctcgctcgcattgactgggatgaggacaagttctactccacctcactcaagaccaggctgaccatcagcaaagatacctctgacaaccaagtggtgctccgcatgaccaacatggacccagccgacactgccacttactactgcgcgaggagcggagcgggcggaacctccgccaccgccttcgatatttggggcccgggtaccatggtcaccgtgtcaagcggaggaggggggtccgggggcggcggttccgggggaggcggatcggacattcagatgactcagtcaccatcgtccctgagcgctagcgtgggcgacagagtgacaatcacttgccgggcatcccaggacatctataacaaccttgcgtggttccagctgaagcctggttccgcaccgcggtcacttatgtacgccgccaacaagagccagtcgggagtgccgtcccggttttccggttcggcctcgggaactgacttcaccctgacgatctccagcctgcaacccgaggatttcgccacctactactgccagcactactaccgctttccctactcgttcggacagggaaccaagctggaaatcaag

SEQ ID NO: 105 - protein, 245 aa, Artificial Sequence
  source: /note="Description of Artificial Sequence: Synthetic scFv sequence"
QVNLRESGPALVKPTQTLTLTCTFSGFSLRTSGMCVSWIRQPPGKALEWLARIDWDEDKFYSTSLKTRLTISKDTSDNQVVLRMTNMDPADTATYYCARSGAGGTSATAFDIWGPGTMVTVSSGGGGSGGGGSGGGGSDIQMTQSPSSLSASVGDRVTITCRASQDIYNNLAWFQLKPGSAPRSLMYAANKSQSGVPSRFSGSASGTDFTLTISSLQPEDFATYYCQHYYRFPYSFGQGTKLEIK

SEQ ID NO: 106 - DNA, 738 bp, Artificial Sequence
  source: /note="Description of Artificial Sequence: Synthetic scFv sequence"
gaagtgcagcttgtcgaatccggggggggactggtcaagccgggcggatcactgagactgtcctgcgccgcgagcggcttcacgttctcctcctactccatgaactgggtccgccaagcccccgggaagggactggaatgggtgtcctctatctcctcgtcgtcgtcctacatctactacgccgactccgtgaagggaagattcaccatttcccgcgacaacgcaaagaactcactgtacttgcaaatgaactcactccgggccgaagatactgctgtgtactattgcgccaagactattgccgccgtctacgctttcgacatctggggccagggaaccaccgtgactgtgtcgtccggtggtggtggctcgggcggaggaggaagcggcggcggggggtccgagattgtgctgacccagtcgccactgagcctccctgtgacccccgaggaacccgccagcatcagctgccggtccagccagtccctgctccactccaacggatacaattacctcgattggtaccttcagaagcctggacaaagcccgcagctgctcatctacttgggatcaaaccgcgcgtcaggagtgcctgaccggttctccggctcgggcagcggtaccgatttcaccctgaaaatctccagggtggaggcagaggacgtgggagtgtattactgtatgcaggcgctgcagactccgtacacatttgggcagggcaccaagctggagatcaag

SEQ ID NO: 107 - DNA, 720 bp, Artificial Sequence
  source: /note="Description of Artificial Sequence: Synthetic scFv sequence"
gaagtccagctcgtggagtccggcggaggccttgtgaagcctggaggttcgctgagactgtcctgcgccgcctccggcttcaccttctccgactactacatgtcctggatcagacaggccccgggaaagggcctggaatgggtgtcctacatctcgtcatcgggcagcactatctactacgcggactcagtgaaggggcggttcaccatttcccgggataacgcgaagaactcgctgtatctgcaaatgaactcactgagggccgaggacaccgccgtgtactactgcgcccgcgatctccgcggggcatttgacatctggggacagggaaccatggtcacagtgtccagcggagggggaggatcgggtggcggaggttccgggggtggaggctcctcctacgtgctgactcagagcccaagcgtcagcgctgcgcccggttacacggcaaccatctcctgtggcggaaacaacattgggaccaagtctgtgcactggtatcagcagaagccgggccaagctcccctgttggtgatccgcgatgactccgtgcggcctagcaaaattccgggacggttctccggctccaacagcggcaatatggccactctcaccatctcgggagtgcaggccggagatgaagccgacttctactgccaagtctgggactcagactccgagcatgtggtgttcgggggcggaaccaagctgactgtgctc

SEQ ID NO: 108 - DNA, 723 bp, Artificial Sequence
  source: /note="Description of Artificial Sequence: Synthetic scFv sequence"
caagtgcagctggtgcagagcggggccgaagtcaagaagccgggagcctccgtgaaagtgtcctgcaagccttcgggatacaccgtgacctcccactacattcattgggtccgccgcgcccccggccaaggactcgagtggatgggcatgatcaaccctagcggcggagtgaccgcgtacagccagacgctgcagggacgcgtgactatgacctcggatacctcctcctccaccgtctatatggaactgtccagcctgcggtccgaggataccgccatgtactactgcgcccgggaaggatcaggctccgggtggtatttcgacttctggggaagaggcaccctcgtgactgtgtcatctgggggagggggttccggtggtggcggatcgggaggaggcggttcatcctacgtgctgacccagccaccctccgtgtccgtgagccccggccagactgcatcgattacatgtagcggcgacggcctctccaagaaatacgtgtcgtggtaccagcagaaggccggacagagcccggtggtgctgatctcaagagataaggagcggcctagcggaatcccggacaggttctcgggttccaactccgcggacactgctactctgaccatctcggggacccaggctatggacgaagccgattactactgccaagcctgggacgacactactgtcgtgtttggagggggcaccaagttgaccgtcctt

SEQ ID NO: 109 - DNA, 735 bp, Artificial Sequence
  source: /note="Description of Artificial Sequence: Synthetic scFv sequence"
caagtgcagcttcaggagagcggcccgggactcgtgaagccgtcccagaccctgtccctgacttgcaccgtgtcgggaggaagcatctcgagcggaggctactattggtcgtggattcggcagcaccctggaaagggcctggaatggatcggctacatctactactccggctcgacctactacaacccatcgctgaagtccagagtgacaatctcagtggacacgtccaagaatcagttcagcctgaagctctcttccgtgactgcggccgacaccgccgtgtactactgcgcacgcgctggaattgccgcccggctgaggggtgccttcgacatttggggacagggcaccatggtcaccgtgtcctccggcggcggaggttccgggggtggaggctcaggaggaggggggtccgacatcgtcatgactcagtcgccctcaagcgtcagcgcgtccgtcggggacagagtgatcatcacctgtcgggcgtcccagggaattcgcaactggctggcctggtatcagcagaagcccggaaaggcccccaacctgttgatctacgccgcctcaaacctccaatccggggtgccgagccgcttcagcggctccggttcgggtgccgatttcactctgaccatctcctccctgcaacctgaagatgtggctacctactactgccaaaagtacaactccgcaccttttactttcggaccggggaccaaagtggacattaag

SEQ ID NO: 110 - DNA, 759 bp, Artificial Sequence
  source: /note="Description of Artificial Sequence: Synthetic scFv sequence"
caagtgcagctggtccagtcgggcgccgaggtcaagaagcccgggagctctgtgaaagtgtcctgcaaggcctccgggggcacctttagctcctacgccatctcctgggtccgccaagcaccgggtcaaggcctggagtggatggggggaattatccctatcttcggcactgccaactacgcccagaagttccagggacgcgtgaccattaccgcggacgaatccacctccaccgcttatatggagctgtccagcttgcgctcggaagataccgccgtgtactactgcgcccggaggggtggataccagctgctgagatgggacgtgggcctcctgcggtcggcgttcgacatctggggccagggcactatggtcactgtgtccagcggaggaggcggatcgggaggcggcggatcagggggaggcggttccagctacgtgcttactcaacccccttcggtgtccgtggccccgggacagaccgccagaatcacttgcggaggaaacaacattgggtccaagagcgtgcattggtaccagcagaagccaggacaggcccctgtgctggtgctctacgggaagaacaatcggcccagcggagtgccggacaggttctcgggttcacgctccggtacaaccgcttcactgactatcaccggggcccaggcagaggatgaagcggactactactgttcctcccgggattcatccggcgaccacctccgggtgttcggaaccggaacgaaggtcaccgtgctg

SEQ ID NO: 111 - DNA, 744 bp, Artificial Sequence
  source: /note="Description of Artificial Sequence: Synthetic scFv sequence"
gaagtgcagctccaacagtcaggaccggggctcgtgaagccatcccagaccctgtccctgacttgtgccatctcgggagatagcgtgtcatcgaactccgccgcctggaactggattcggcagagcccgtcccgcggactggagtggcttggaaggacctactaccggtccaagtggtactctttctacgcgatctcgctgaagtcccgcattatcattaaccctgatacctccaagaatcagttctccctccaactgaaatccgtcacccccgaggacacagcagtgtattactgcgcacggagcagccccgaaggactgttcctgtattggtttgacccctggggccaggggactcttgtgaccgtgtcgagcggcggagatgggtccggtggcggtggttcggggggcggcggatcatcatccgaactgacccaggacccggctgtgtccgtggcgctgggacaaaccatccgcattacgtgccagggagactccctgggcaactactacgccacttggtaccagcagaagccgggccaagcccctgtgttggtcatctacgggaccaacaacagaccttccggcatccccgaccggttcagcgcttcgtcctccggcaacactgccagcctgaccatcactggagcgcaggccgaagatgaggccgactactactgcaacagcagagactcctcgggtcatcacctcttgttcggaactggaaccaaggtcaccgtgctg

SEQ ID NO: 112 - DNA, 744 bp, Artificial Sequence
  source: /note="Description of Artificial Sequence: Synthetic scFv sequence"
gaagtgcaactggtggaaaccggtggaggactcgtgcagcctggcggcagcctccggctgagctgcgccgcttcgggattcaccttttcctcctacgcgatgtcttgggtcagacaggcccccggaaaggggctggaatgggtgtcagccatctccggctccggcggatcaacgtactacgccgactccgtgaaaggccggttcaccatgtcgcgcgagaatgacaagaactccgtgttcctgcaaatgaactccctgagggtggaggacaccggagtgtactattgtgcgcgcgccaactacaagagagagctgcggtactactacggaatggacgtctggggacagggaactatggtgaccgtgtcatccggtggagggggaagcggcggtggaggcagcgggggcgggggttcagaaattgtcatgacccagtccccgggaactctttccctctcccccggggaatccgcgactttgtcctgccgggccagccagcgcgtggcctcgaactacctcgcatggtaccagcataagccaggccaagccccttccctgctgatttccggggctagcagccgcgccactggcgtgccggataggttctcgggaagcggctcgggtaccgatttcaccctggcaatctcgcggctggaaccggaggattcggccgtgtactactgccagcactatgactcatccccctcctggacattcggacagggcaccaaggtcgagatcaag

SEQ ID NO: 113 - DNA, 738 bp, Artificial Sequence
  source: /note="Description of Artificial Sequence: Synthetic scFv sequence"
gaagtgcagctcgtggagtcaggaggcggcctggtccagccgggagggtcccttagactgtcatgcgccgcaagcggattcactttctcctcctatgccatgagctgggtccgccaagcccccggaaagggactggaatgggtgtccgccatctcggggtctggaggctcaacttactacgctgactccgtgaagggacggttcaccattagccgcgacaactccaagaacaccctctacctccaaatgaactccctgcgggccgaggataccgccgtctactactgcgccaaagtggaaggttcaggatcgctggactactggggacagggtactctcgtgaccgtgtcatcgggcggaggaggttccggcggtggcggctccggcggcggagggtcggagatcgtgatgacccagagccctggtactctgagcctttcgccgggagaaagggccaccctgtcctgccgcgcttcccaatccgtgtcctccgcgtacttggcgtggtaccagcagaagccgggacagccccctcggctgctgatcagcggggccagcacccgggcaaccggaatcccagacagattcgggggttccggcagcggcacagatttcaccctgactatttcgaggttggagcccgaggactttgcggtgtattactgtcagcactacgggtcgtcctttaatggctccagcctgttcacgttcggacaggggacccgcctggaaatcaag

SEQ ID NO: 114 - DNA, 744 bp, Artificial Sequence
  source: /note="Description of Artificial Sequence: Synthetic scFv sequence"
gaggtgcagcttgtggaaaccggtggcggactggtgcagcccggaggaagcctcaggctgtcctgcgccgcgtccggcttcaccttctcctcgtacgccatgtcctgggtccgccaggcccccggaaagggcctggaatgggtgtccgccatctctggaagcggaggttccacgtactacgcggacagcgtcaagggaaggttcacaatctcccgcgataattcgaagaacactctgtaccttcaaatgaacaccctgaaggccgaggacactgctgtgtactactgcgcacgggccacctacaagagagagctccggtactactacggaatggacgtctggggccagggaactactgtgaccgtgtcctcgggagggggtggctccggggggggcggctccggcggaggcggttccgagattgtgctgacccagtcaccttcaactctgtcgctgtccccgggagagagcgctactctgagctgccgggccagccagtccgtgtccaccaccttcctcgcctggtatcagcagaagccggggcaggcaccacggctcttgatctacgggtcaagcaacagagcgaccggaattcctgaccgcttctcggggagcggttcaggcaccgacttcaccctgactatccggcgcctggaacccgaagatttcgccgtgtattactgtcaacagtaccactcctcgccgtcctggacctttggccaaggaaccaaagtggaaatcaag

SEQ ID NO: 115 - DNA, 717 bp, Artificial Sequence
  source: /note="Description of Artificial Sequence: Synthetic scFv sequence"
gaagtgcagctcgtggaaactggaggtggactcgtgcagcctggacggtcgctgcggctgagctgcgctgcatccggcttcaccttcgacgattatgccatgcactgggtcagacaggcgccagggaagggacttgagtgggtgtccggtatcagctggaatagcggctcaatcggatacgcggactccgtgaagggaaggttcaccatttcccgcgacaacgccaagaactccctgtacttgcaaatgaacagcctccgggatgaggacactgccgtgtactactgcgcccgcgtcggaaaagctgtgcccgacgtctggggccagggaaccactgtgaccgtgtccagcggcgggggtggatcgggcggtggagggtccggtggagggggctcagatattgtgatgacccagaccccctcgtccctgtccgcctcggtcggcgaccgcgtgactatcacatgtagagcctcgcagagcatctccagctacctgaactggtatcagcagaagccggggaaggccccgaagctcctgatctacgcggcatcatcactgcaatcgggagtgccgagccggttttccgggtccggctccggcaccgacttcacgctgaccatttcttccctgcaacccgaggacttcgccacttactactgccagcagtcctactccaccccttactccttcggccaaggaaccaggctggaaatcaag

SEQ ID NO: 116 - DNA, 732 bp, Artificial Sequence
  source: /note="Description of Artificial Sequence: Synthetic scFv sequence"
gaagtgcagctgctcgaaaccggtggagggctggtgcagccagggggctccctgaggctttcatgcgccgctagcggattctccttctcctcttacgccatgtcgtgggtccgccaagcccctggaaaaggcctggaatgggtgtccgcgatttccgggagcggaggttcgacctattacgccgactccgtgaagggccgctttaccatctcccgggataactccaagaacactctgtacctccaaatgaactcgctgagagccgaggacaccgccgtgtattactgcgcgaaggcgctggtcggcgcgactggggcattcgacatctggggacagggaactcttgtgaccgtgtcgagcggaggcggcggctccggcggaggagggagcgggggcggtggttccgaaatcgtgttgactcagtccccgggaaccctgagcttgtcacccggggagcgggccactctctcctgtcgcgcctcccaatcgctctcatccaatttcctggcctggtaccagcagaagcccggacaggccccgggcctgctcatctacggcgcttcaaactgggcaacgggaacccctgatcggttcagcggaagcggatcgggtactgactttaccctgaccatcaccagactggaaccggaggacttcgccgtgtactactgccagtactacggcacctcccccatgtacacattcggacagggtaccaaggtcgagattaag

SEQ ID NO: 117 - DNA, 723 bp, Artificial Sequence
  source: /note="Description of Artificial Sequence: Synthetic scFv sequence"
gaagtgcaactggtggaaaccggtggcggcctggtgcagcctggaggatcattgaggctgtcatgcgcggccagcggtattaccttctcccggtaccccatgtcctgggtcagacaggccccggggaaagggcttgaatgggtgtccgggatctcggactccggtgtcagcacttactacgccgactccgccaagggacgcttcaccatttcccgggacaactcgaagaacaccctgttcctccaaatgagctccctccgggacgaggatactgcagtgtactactgcgtgacccgcgccgggtccgaggcgtctgacatttggggacagggcactatggtcaccgtgtcgtccggcggagggggctcgggaggcggtggcagcggaggaggagggtccgagatcgtgctgacccaatccccggccaccctctcgctgagccctggagaaagggcaaccttgtcctgtcgcgcgagccagtccgtgagcaactccctggcctggtaccagcagaagcccggacaggctccgagacttctgatctacgacgcttcgagccgggccactggaatccccgaccgcttttcggggtccggctcaggaaccgatttcaccctgacaatctcacggctggagccagaggatttcgccatctattactgccagcagttcggtacttcctccggcctgactttcggaggcggcacgaagctcgaaatcaag

SEQ ID NO: 118 - DNA, 739 bp, Artificial Sequence
  source: /note="Description of Artificial Sequence: Synthetic scFv sequence"
gaagtccaactggtggagtccgggggagggctcgtgcagcccggaggcagccttcggctgtcgtgcgccgcctccgggttcacgttctcatcctacgcgatgtcgtgggtcagacaggcaccaggaaagggactggaatgggtgtccgccattagcggctccggcggtagcacctactatgccgactcagtgaagggaaggttcactatctcccgcgacaacagcaagaacaccctgtacctccaaatgaactctctgcgggccgaggataccgcggtgtactattgcgccaagatgggttggtccagcggatacttgggagccttcgacatttggggacagggcactactgtgaccgtgtcctccgggggtggcggatcgggaggcggcggctcgggtggagggggttccgaaatcgtgttgacccagtcaccgggaaccctctcgctgtccccgggagaacgggctacactgtcatgtagagcgtcccagtccgtggcttcctcgttcctggcctggtaccagcagaagccgggacaggcaccccgcctgctcatctacggagccagcggccgggcgaccggcatccctgaccgcttctccggttccggctcgggcaccgactttactctgaccattagcaggcttgagcccgaggattttgccgtgtactactgccaacactacggggggagccctcgcctgaccttcggaggcggaactaaggtcgatatcaaaa

SEQ ID NO: 119 - DNA, 744 bp, Artificial Sequence
  source: /note="Description of Artificial Sequence: Synthetic scFv sequence"
caagtgcagctcgtggaatcgggtggcggactggtgcagccggggggctcacttagactgtcctgcgcggccagcggattcactttctcctcctacgccatgtcctgggtcagacaggcccctggaaagggcctggaatgggtgtccgcaatcagcggcagcggcggctcgacctattacgcggattcagtgaagggcagattcaccatttcccgggacaacgccaagaactccttgtaccttcaaatgaactccctccgcgcggaagataccgcaatctactactgcgctcgggccacttacaagagggaactgcgctactactacgggatggacgtctggggccagggaaccatggtcaccgtgtccagcggaggaggaggatcgggaggaggcggtagcgggggtggagggtcggagatcgtgatgacccagtcccccggcactgtgtcgctgtcccccggcgaacgggccaccctgtcatgtcgggccagccagtcagtgtcgtcaagcttcctcgcctggtaccagcagaaaccgggacaagctccccgcctgctgatctacggagccagcagccgggccaccggtattcctgaccggttctccggttcggggtccgggaccgactttactctgactatctctcgcctcgagccagaggactccgccgtgtattactgccagcagtaccactcctccccgtcctggacgttcggacagggcacaaggctggagattaag

SEQ ID NO: 120 - DNA, 738 bp, Artificial Sequence
  source: /note="Description of Artificial Sequence: Synthetic scFv sequence"
gaagtgcagctcgtggagagcgggggaggattggtgcagcccggaaggtccctgcggctctcctgcactgcgtctggcttcaccttcgacgactacgcgatgcactgggtcagacagcgcccgggaaagggcctggaatgggtcgcctcaatcaactggaagggaaactccctggcctatggcgacagcgtgaagggccgcttcgccatttcgcgcgacaacgccaagaacaccgtgtttctgcaaatgaattccctgcggaccgaggataccgctgtgtactactgcgccagccaccagggcgtggcatactataactacgccatggacgtgtggggaagagggacgctcgtcaccgtgtcctccgggggcggtggatcgggtggaggaggaagcggtggcgggggcagcgaaatcgtgctgactcagagcccgggaactctttcactgtccccgggagaacgggccactctctcgtgccgggccacccagtccatcggctcctccttccttgcctggtaccagcagaggccaggacaggcgccccgcctgctgatctacggtgcttcccaacgcgccactggcattcctgaccggttcagcggcagagggtcgggaaccgatttcacactgaccatttcccgggtggagcccgaagattcggcagtctactactgtcagcattacgagtcctccccttcatggaccttcggtcaagggaccaaagtggagatcaag

SEQ ID NO: 121 - DNA, 733 bp, Artificial Sequence
  source: /note="Description of Artificial Sequence: Synthetic scFv sequence"
gaagtgcagctgcttgagagcggtggaggtctggtgcagcccgggggatcactgcgcctgtcctgtgccgcgtccggtttcactttctcctcgtacgccatgtcgtgggtcagacaggcaccgggaaagggactggaatgggtgtcagccatttcgggttcggggggcagcacctactacgctgactccgtgaagggccggttcaccatttcccgcgacaactccaagaacaccttgtacctccaaatgaactccctgcgggccgaagataccgccgtgtattactgcgtgctgtggttcggagagggattcgacccgtggggacaaggaacactcgtgactgtgtcatccggcggaggcggcagcggtggcggcggttccggcggcggcggatctgacatcgtgttgacccagtcccctctgagcctgccggtcactcctggcgaaccagccagcatctcctgccggtcgagccagtccctcctgcactccaatgggtacaactacctcgattggtatctgcaaaagccgggccagagcccccagctgctgatctaccttgggtcaaaccgcgcttccggggtgcctgatagattctccgggtccgggagcggaaccgactttaccctgaaaatctcgagggtggaggccgaggacgtcggagtgtactactgcatgcaggcgctccagactcccctgaccttcggaggaggaacgaaggtcgacatcaaga

SEQ ID NO: 122 - DNA, 726 bp, Artificial Sequence
  source: /note="Description of Artificial Sequence: Synthetic scFv sequence"
gaagtgcagctgctggagtccggcggtggattggtgcaaccggggggatcgctcagactgtcctgtgcggcgtcaggcttcaccttctcgagctacgccatgtcatgggtcagacaggcccctggaaagggtctggaatgggtgtccgccatttccgggagcgggggatctacatactacgccgatagcgtgaagggccgcttcaccatttcccgggacaactccaagaacactctctatctgcaaatgaactccctccgcgctgaggacactgccgtgtactactgcgccaaaatccctcagaccggcaccttcgactactggggacaggggactctggtcaccgtcagcagcggtggcggaggttcggggggaggaggaagcggcggcggagggtccgagattgtgctgacccagtcacccggcactttgtccctgtcgcctggagaaagggccaccctttcctgccgggcatcccaatccgtgtcctcctcgtacctggcctggtaccagcagaggcccggacaggccccacggcttctgatctacggagcaagcagccgcgcgaccggtatcccggaccggttttcgggctcgggctcaggaactgacttcaccctcaccatctcccgcctggaacccgaagatttcgctgtgtattactgccagcactacggcagctccccgtcctggacgttcggccagggaactcggctggagatcaag

SEQ ID NO: 123 - DNA, 723 bp, Artificial Sequence
  source: /note="Description of Artificial Sequence: Synthetic scFv sequence"
gaggtgcagttggtcgaaagcgggggcgggcttgtgcagcctggcggatcactgcggctgtcctgcgcggcatcaggcttcacgttttcttcctacgccatgtcctgggtgcgccaggcccctggaaagggactggaatgggtgtccgcgatttcggggtccggcgggagcacctactacgccgattccgtgaagggccgcttcactatctcgcgggacaactccaagaacaccctctacctccaaatgaatagcctgcgggccgaggataccgccgtctactattgcgctaaggtcgtgcgcgacggaatggacgtgtggggacagggtaccaccgtgacagtgtcctcggggggaggcggtagcggcggaggaggaagcggtggtggaggttccgagattgtgctgactcaatcacccgcgaccctgagcctgtcccccggcgaaagggccactctgtcctgtcgggccagccaatcagtctcctcctcgtacctggcctggtaccagcagaagccaggacaggctccgagactccttatctatggcgcatcctcccgcgccaccggaatcccggataggttctcgggaaacggatcggggaccgacttcactctcaccatctcccggctggaaccggaggacttcgccgtgtactactgccagcagtacggcagcccgcctagattcactttcggccccggcaccaaagtggacatcaag

SEQ ID NO: 124 - DNA, 753 bp, Artificial Sequence
  source: /note="Description of Artificial Sequence: Synthetic scFv sequence"
caagtgcagctcgtggagtcaggcggaggactggtgcagcccgggggctccctgagactttcctgcgcggcatcgggttttaccttctcctcctatgctatgtcctgggtgcgccaggccccgggaaagggactggaatgggtgtccgcaatcagcggtagcgggggctcaacatactacgccgactccgtcaagggtcgcttcactatttcccgggacaactccaagaataccctgtacctccaaatgaacagcctcagggccgaggatactgccgtgtactactgcgccaaagtcggatacgatagctccggttactaccgggactactacggaatggacgtgtggggacagggcaccaccgtgaccgtgtcaagcggcggaggcggttcaggagggggaggctccggcggtggagggtccgaaatcgtcctgactcagtcgcctggcactctgtcgttgtccccgggggagcgcgctaccctgtcgtgtcgggcgtcgcagtccgtgtcgagctcctacctcgcgtggtaccagcagaagcccggacaggcccctagacttctgatctacggcacttcttcacgcgccaccgggatcagcgacaggttcagcggctccggctccgggaccgacttcaccctgaccattagccggctggagcctgaagatttcgccgtgtattactgccaacactacggaaactcgccgccaaagttcacgttcggacccggaaccaagctggaaatcaag

SEQ ID NO: 125 - protein, 112 aa, Artificial Sequence
  source: /note="Description of Artificial Sequence: Synthetic scFv sequence"
DIVLTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPLTFGGGTKVDIK

SEQ ID NO: 126 - protein, 249 aa, Artificial Sequence
  source: /note="Description of Artificial Sequence: Synthetic scFv sequence"
QVQLVQSGAEVRKTGASVKVSCKASGYIFDNFGINWVRQAPGQGLEWMGWINPKNNNTNYAQKFQGRVTITADESTNTAYMEVSSLRSEDTAVYYCARGPYYYQSYMDVWGQGTMVTVSSASGGGGSGGRASGGGGSDIVMTQTPLSLPVTPGEPASISCRSSQSLLHSNGYNYLNWYLQKPGQSPQLLIYLGSKRASGVPDRFSGSGSGTDFTLHITRVGAEDVGVYYCMQALQTPYTFGQGTKLEIK

SEQ ID NO: 127 - protein, 246 aa, Artificial Sequence
  source: /note="Description of Artificial Sequence: Synthetic scFv sequence"
QVQLQESGGGLVQPGGSLRLSCAASGFTFSSDAMTWVRQAPGKGLEWVSVISGSGGTTYYADSVKGRFTISRDNSKNTLYLQMNSLRAEDTAVYYCAKLDSSGYYYARGPRYWGQGTLVTVSSASGGGGSGGRASGGGGSDIQLTQSPSSLSASVGDRVTITCRASQSISSYLNWYQQKPGKAPKLLIYGASTLASGVPARFSGSGSGTHFTLTINSLQSEDSATYYCQQSYKRASFGQGTKVEIK

SEQ ID NO: 128 - protein, 246 aa, Artificial Sequence
  source: /note="Description of Artificial Sequence: Synthetic scFv sequence"
QVQLVESGGGLVQPGRSLRLSCAASGFTFSNYAMSWVRQAPGKGLGWVSGISRSGENTYYADSVKGRFTISRDNSKNTLYLQMNSLRDEDTAVYYCARSPAHYYGGMDVWGQGTTVTVSSASGGGGSGGRASGGGGSDIVLTQSPGTLSLSPGERATLSCRASQSISSSFLAWYQQKPGQAPRLLIYGASRRATGIPDRFSGSGSGTDFTLTISRLEPEDSAVYYCQQYHSSPSWTFGQGTKLEIK

SEQ ID NO: 129 - protein, 244 aa, Artificial Sequence
  source: /note="Description of Artificial Sequence: Synthetic scFv sequence"
QVQLVESGGGLVQPGRSLRLSCAASGFTFDDYAMHWVRQAPGKGLEWVSGISWNSGSIGYADSVKGRFTISRDNAKNSLYLQMNSLRAEDTALYYCSVHSFLAYWGQGTLVTVSSASGGGGSGGRASGGGGSDIVMTQTPLSLPVTPGEPASISCRSSQSLLHSNGYNYLDWYLQKPGQSPQLLIYLGSNRASGVPDRFSGSGSGTDFTLKISRVEAEDVGVYYCMQALQTPYTFGQGTKVEIK

SEQ ID NO: 130 - DNA, 717 bp, Artificial Sequence
  source: /note="Description of Artificial Sequence: Synthetic scFv sequence"
gaagtgcaattggtggaatcagggggaggacttgtgcagcctggaggatcgctgagactgtcatgtgccgtgtccggctttgccctgtccaaccacgggatgtcctgggtccgccgcgcgcctggaaagggcctcgaatgggtgtcgggtattgtgtacagcggtagcacctactatgccgcatccgtgaaggggagattcaccatcagccgggacaactccaggaacactctgtacctccaaatgaattcgctgaggccagaggacactgccatctactactgctccgcgcatggcggagagtccgacgtctggggacaggggaccaccgtgaccgtgtctagcgcgtccggcggaggcggcagcgggggtcgggcatcagggggcggcggatcggacatccagctcacccagtccccgagctcgctgtccgcctccgtgggagatcgggtcaccatcacgtgccgcgccagccagtcgatttcctcctacctgaactggtaccaacagaagcccggaaaagccccgaagcttctcatctacgccgcctcgagcctgcagtcaggagtgccctcacggttctccggctccggttccggtactgatttcaccctgaccatttcctccctgcaaccggaggacttcgctacttactactgccagcagtcgtactccaccccctacactttcggacaaggcaccaaggtcgaaatcaag

SEQ ID NO: 131 - protein, 246 aa, Artificial Sequence
  source: /note="Description of Artificial Sequence: Synthetic scFv sequence"
QVQLVQSGGGLVKPGGSLRLSCAASGFTFSDYYMSWIRQAPGKGLEWVSYISSSGNTIYYADSVKGRFTISRDNAKNSLYLQMNSLRAEDTAVYYCARSTMVREDYWGQGTLVTVSSASGGGGSGGRASGGGGSDIVLTQSPLSLPVTLGQPASISCKSSESLVHNSGKTYLNWFHQRPGQSPRRLIYEVSNRDSGVPDRFTGSGSGTDFTLKISRVEAEDVGVYYCMQGTHWPGTFGQGTKLEIK

SEQ ID NO: 132 - protein, 243 aa, Artificial Sequence
  source: /note="Description of Artificial Sequence: Synthetic scFv sequence"
EVQLLESGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSSASGGGGSGGRASGGGGSDIVMTQTPLSLSVTPGQPASISCKSSQSLLRNDGKTPLYWYLQKAGQPPQLLIYEVSNRFSGVPDRFSGSGSGTDFTLKISRVEAEDVGAYYCMQNIQFPSFGGGTKLEIK

SEQ ID NO: 133 - protein, 243 aa, Artificial Sequence
  source: /note="Description of Artificial Sequence: Synthetic scFv sequence"
QVQLQESGPGLVKPSETLSLTCTVSGGSISSSYYYWGWIRQPPGKGLEWIGSIYYSGSAYYNPSLKSRVTISVDTSKNQFSLRLSSVTAADTAVYYCARHWQEWPDAFDIWGQGTMVTVSSGGGGSGGGGSGGGGSETTLTQSPAFMSATPGDKVIISCKASQDIDDAMNWYQQKPGEAPLFIIQSATSPVPGIPPRFSGSGFGTDFSLTINNIESEDAAYYFCLQHDNFPLTFGQGTKLEIK

SEQ ID NO: 134 - protein, 246 aa, Artificial Sequence
  source: /note="Description of Artificial Sequence: Synthetic scFv sequence"
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCAKTIAAVYAFDIWGQGTTVTVSSGGGGSGGGGSGGGGSEIVLTQSPLSLPVTPEEPASISCRSSQSLLHSNGYNYLDWYLQKPGQSPQLLIYLGSNRASGVPDRFSGSGSGTDFTLKISRVEAEDVGVYYCMQALQTPYTFGQGTKLEIK

SEQ ID NO: 135 - protein, 245 aa, Artificial Sequence
  source: /note="Description of Artificial Sequence: Synthetic scFv sequence"
QVQLQESGPGLVKPSQTLSLTCTVSGGSISSGGYYWSWIRQHPGKGLEWIGYIYYSGSTYYNPSLKSRVTISVDTSKNQFSLKLSSVTAADTAVYYCARAGIAARLRGAFDIWGQGTMVTVSSGGGGSGGGGSGGGGSDIVMTQSPSSVSASVGDRVIITCRASQGIRNWLAWYQQKPGKAPNLLIYAASNLQSGVPSRFSGSGSGADFTLTISSLQPEDVATYYCQKYNSAPFTFGPGTKVDIK

SEQ ID NO: 136 - protein, 253 aa, Artificial Sequence
  source: /note="Description of Artificial Sequence: Synthetic scFv sequence"
QVQLVQSGAEVKKPGSSVKVSCKASGGTFSSYAISWVRQAPGQGLEWMGGIIPIFGTANYAQKFQGRVTITADESTSTAYMELSSLRSEDTAVYYCARRGGYQLLRWDVGLLRSAFDIWGQGTMVTVSSGGGGSGGGGSGGGGSSYVLTQPPSVSVAPGQTARITCGGNNIGSKSVHWYQQKPGQAPVLVLYGKNNRPSGVPDRFSGSRSGTTASLTITGAQAEDEADYYCSSRDSSGDHLRVFGTGTKVTVL

SEQ ID NO: 137 - protein, 248 aa, Artificial Sequence
  source: /note="Description of Artificial Sequence: Synthetic scFv sequence"
EVQLQQSGPGLVKPSQTLSLTCAISGDSVSSNSAAWNWIRQSPSRGLEWLGRTYYRSKWYSFYAISLKSRIIINPDTSKNQFSLQLKSVTPEDTAVYYCARSSPEGLFLYWFDPWGQGTLVTVSSGGDGSGGGGSGGGGSSSELTQDPAVSVALGQTIRITCQGDSLGNYYATWYQQKPGQAPVLVIYGTNNRPSGIPDRFSASSSGNTASLTITGAQAEDEADYYCNSRDSSGHHLLFGTGTKVTVL

SEQ ID NO: 138 - protein, 244 aa, Artificial Sequence
  source: /note="Description of Artificial Sequence: Synthetic scFv sequence"
QIQLVQSGPDLKKPGETVKLSCKASGYTFTNFGMNWVKQAPGKGFKWMAWINTYTGESYFADDFKGRFAFSVETSATTAYLQINNLKTEDTATYFCARGEIYYGYDGGFAYWGQGTLVTVSAGGGGSGGGGSGGGGSDVVMTQSHRFMSTSVGDRVSITCRASQDVNTAVSWYQQKPGQSPKLLIFSASYRYTGVPDRFTGSGSGADFTLTISSVQAEDLAVYYCQQHYSTPWTFGGGTKLDIK

SEQ ID NO: 139 - protein, 249 aa, Artificial Sequence
  source: /note="Description of Artificial Sequence: Synthetic scFv sequence"
QIQLVQSGPELKKPGETVKISCKASGYTFTDYSINWVKRAPGKGLKWMGWINTETREPAYAYDFRGRFAFSLETSASTAYLQINNLKYEDTATYFCALDYSYAMDYWGQGTSVTVSSGGGGSGGGGSGGGGSQIQLVQSGPELKKPGETVKISCKASGYTFTDYSINWVKRAPGKGLKWMGWINTETREPAYAYDFRGRFAFSLETSASTAYLQINNLKYEDTATYFCALDYSYAMDYWGQGTSVTVSS

SEQ ID NO: 140 - protein, 243 aa, Artificial Sequence
  source: /note="Description of Artificial Sequence: Synthetic scFv sequence"
QIQLVQSGPELKKPGETVKISCKASGYTFRHYSMNWVKQAPGKGLKWMGRINTESGVPIYADDFKGRFAFSVETSASTAYLVINNLKDEDTASYFCSNDYLYSLDFWGQGTALTVSSGGGGSGGGGSGGGGSDIVLTQSPPSLAMSLGKRATISCRASESVTILGSHLIYWYQQKPGQPPTLLIQLASNVQTGVPARFSGSGSRTDFTLTIDPVEEDDVAVYYCLQSRTIPRTFGGGTKLEIK

SEQ ID NO: 141 - protein, 243 aa, Artificial Sequence
  source: /note="Description of Artificial Sequence: Synthetic scFv sequence"
QIQLVQSGPELKKPGETVKISCKASGYTFTHYSMNWVKQAPGKGLKWMGRINTETGEPLYADDFKGRFAFSLETSASTAYLVINNLKNEDTATFFCSNDYLYSCDYWGQGTTLTVSSGGGGSGGGGSGGGGSDIVLTQSPPSLAMSLGKRATISCRASESVTILGSHLIYWYQQKPGQPPTLLIQLASNVQTGVPARFSGSGSRTDFTLTIDPVEEDDVAVYYCLQSRTIPRTFGGGTKLEIK

SEQ ID NO: 142 - protein, 246 aa, Artificial Sequence
  source: /note="Description of Artificial Sequence: Synthetic scFv sequence"
EVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCAKVEGSGSLDYWGQGTLVTVSSGGGGSGGGGSGGGGSEIVMTQSPGTLSLSPGERATLSCRASQSVSSAYLAWYQQKPGQPPRLLISGASTRATGIPDRFGGSGSGTDFTLTISRLEPEDFAVYYCQHYGSSFNGSSLFTFGQGTRLEIK

SEQ ID NO: 143 - protein, 248 aa, Artificial Sequence
  source: /note="Description of Artificial Sequence: Synthetic scFv sequence"
EVQLVETGGGLVQPGGSLRLSCAASGFTFSSYAMSWVRQAPGKGLEWVSAISGSGGSTYYADSVKGRFTISRDNSKNTLYLQMNTLKAEDTAVYYCARATYKRELRYYYGMDVWGQGTTVTVSSGGGGSGGGGSGGGGSEIVLTQSPSTLSLSPGESATLSCRASQSVSTTFLAWYQQKPGQAPRLLIYGSSNRATGIPDRFSGSGSGTDFTLTIRRLEPEDFAVYYCQQYHSSPSWTFGQGTKVEIK

SEQ ID NO: 144 - protein, 244 aa, Artificial Sequence
  source: /note="Description of Artificial Sequence: Synthetic scFv sequence"
EVQLLETGGGLVQPGGSLRLSCAASGFSFSSYAMSWVRQAPGKGLEWVSAISGSGGSTYYADSVKGRFTISRDNSKNTLYLQMNSLRAEDTAVYYCAKALVGATGAFDIWGQGTLVTVSSGGGGSGGGGSGGGGSEIVLTQSPGTLSLSPGERATLSCRASQSLSSNFLAWYQQKPGQAPGLLIYGASNWATGTPDRFSGSGSGTDFTLTITRLEPEDFAVYYCQYYGTSPMYTFGQGTKVEIK

SEQ ID NO: 145 - protein, 246 aa, Artificial Sequence
  source: /note="Description of Artificial Sequence: Synthetic scFv sequence"
EVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCAKMGWSSGYLGAFDIWGQGTTVTVSSGGGGSGGGGSGGGGSEIVLTQSPGTLSLSPGERATLSCRASQSVASSFLAWYQQKPGQAPRLLIYGASGRATGIPDRFSGSGSGTDFTLTISRLEPEDFAVYYCQHYGGSPRLTFGGGTKVDIK

SEQ ID NO: 146 - protein, 248 aa, Artificial Sequence
  source: /note="Description of Artificial Sequence: Synthetic scFv sequence"
QVQLVESGGGLVQPGGSLRLSCAASGFTFSSYAMSWVRQAPGKGLEWVSAISGSGGSTYYADSVKGRFTISRDNAKNSLYLQMNSLRAEDTAIYYCARATYKRELRYYYGMDVWGQGTMVTVSSGGGGSGGGGSGGGGSEIVMTQSPGTVSLSPGERATLSCRASQSVSSSFLAWYQQKPGQAPRLLIYGASSRATGIPDRFSGSGSGTDFTLTISRLEPEDSAVYYCQQYHSSPSWTFGQGTRLEIK

SEQ ID NO: 147 - protein, 246 aa, Artificial Sequence
  source: /note="Description of Artificial Sequence: Synthetic scFv sequence"
EVQLVESGGGLVQPGRSLRLSCTASGFTFDDYAMHWVRQRPGKGLEWVASINWKGNSLAYGDSVKGRFAISRDNAKNTVFLQMNSLRTEDTAVYYCASHQGVAYYNYAMDVWGRGTLVTVSSGGGGSGGGGSGGGGSEIVLTQSPGTLSLSPGERATLSCRATQSIGSSFLAWYQQRPGQAPRLLIYGASQRATGIPDRFSGRGSGTDFTLTISRVEPEDSAVYYCQHYESSPSWTFGQGTKVEIK

SEQ ID NO: 148 - protein, 244 aa, Artificial Sequence
  source: /note="Description of Artificial Sequence: Synthetic scFv sequence"
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCVLWFGEGFDPWGQGTLVTVSSGGGGSGGGGSGGGGSDIVLTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPLTFGGGTKVDIK

SEQ ID NO: 149 - protein, 242 aa, Artificial Sequence
  source: /note="Description of Artificial Sequence: Synthetic scFv sequence"
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKIPQTGTFDYWGQGTLVTVSSGGGGSGGGGSGGGGSEIVLTQSPGTLSLSPGERATLSCRASQSVSSSYLAWYQQRPGQAPRLLIYGASSRATGIPDRFSGSGSGTDFTLTISRLEPEDFAVYYCQHYGSSPSWTFGQGTRLEIK

SEQ ID NO: 150 - protein, 245 aa, Artificial Sequence
  source: /note="Description of Artificial Sequence: Synthetic scFv sequence"
DIELTQSPSSLAVSAGEKVTMSCKSSQSILYSSNQKNYLAWYQQKPGQSPKLLIYWASTRESGVPDRFTGSGSGTDFTLTISSVQAEDLAVYYCHQYLSSYTFGGGTKLEIKGGGGSGGGGSGGGGSQVQLQQSGPELVRPGASVRISCKASGYTFASYYIQWMKQRPGQGLEWIGWINPGNVNTKYNEKFKGKATLTADKSSTTAYMQLSSLTSEDSAVYFCARSTYYRPLDYWGQGTTVTVSS

SEQ ID NO: 151 - protein, 235 aa, Artificial Sequence
  source: /note="Description of Artificial Sequence: Synthetic scFv sequence"
DIELTQSPSSLAVSAGEKVTMSCKSSQSILYSSNQKNYLAWYQQKPGQSPKLLIYWASTRESGVPDRFTGSGSGTDFTLTISSVQAEDLAVYYCHQYLSSYTFGGGTKLEIKGGGGSQVQLQQSGPELVRPGASVRISCKASGYTFASYYIQWMKQRPGQGLEWIGWINPGNVNTKYNEKFKGKATLTADKSSTTAYMQLSSLTSEDSAVYFCARSTYYRPLDYWGQGTTVTVSS

SEQ ID NO: 152 - protein, 244 aa, Artificial Sequence
  source: /note="Description of Artificial Sequence: Synthetic scFv sequence"
DIVLTQSPASLAVSLGQRATISCRASESVDNYGNTFMHWYQQKPGQPPKLLIYRASNLESGIPARFSGSGSRTDFTLTINPVEADDVATYYCQQSNEDPPTFGAGTKLELKGGGGSGGGGSSGGGSQIQLVQSGPELKKPGETVKISCKASGYIFTNYGMNWVKQAPGKSFKWMGWINTYTGESTYSADFKGRFAFSLETSASTAYLHINDLKNEDTATYFCARSGGYDPMDYWGQGTSVTVSS

SEQ ID NO: 153 - protein, 237 aa, Artificial Sequence
  source: /note="Description of Artificial Sequence: Synthetic scFv sequence"
DVQITQSPSYLAASPGETITINCRASKSISKDLAWYQEKPGKTNKLLIYSGSTLQSGIPSRFSGSGSGTDFTLTISSLEPEDFAMYYCQQHNKYPYTFGGGTKLEIKGGGGSGGGGSSGGGSQVQLQQPGAELVRPGASVKLSCKASGYTFTSYWMNWVKQRPDQGLEWIGRIDPYDSETHYNQKFKDKAILTVDKSSSTAYMQLSSLTSEDSAVYYCARGNWDDYWGQGTTLTVSS

SEQ ID NO: 154 - protein, 263 aa, Artificial Sequence
  source: /note="Description of Artificial Sequence: Synthetic scFv sequence"
MALPVTALLLPLALLLHAARPDVQLTQSPSFLSASVGDRVTITCRASKSISKDLAWYQQKPGKAPKLLIYSGSTLQSGVPSRFSGSGSGTEFTLTISSLQPEDFATYYCQQHNKYPYTFGGGTKVEIKGGGGSGGGGSGGGGSGGGGSEVQLVESGGGLVQPGGSLRLSCAASGYTFTSYWMNWVRQAPGKGLVWVSRIDPYDSETHYNQKFKDRFTISVDKAKSTAYLQMNSLRAEDTAVYYCARGNWDDYWGQGTTVTVSS

SEQ ID NO: 155 - protein, 263 aa, Artificial Sequence
  source: /note="Description of Artificial Sequence: Synthetic scFv sequence"
MALPVTALLLPLALLLHAARPDVQLTQSPSFLSASVGDRVTITCRASKSISKDLAWYQQKPGKAPKLLIYSGSTLQSGVPSRFSGSGSGTEFTLTISSLQPEDFATYYCQQHNKYPYTFGGGTKVEIKGGGGSGGGGSGGGGSGGGGSEVQLVQSGAEVKKPGESLRISCKGSGYTFTSYWMNWVRQMPGKGLEWMGRIDPYDSETHYNQKFKDHVTISVDKSISTAYLQWSSLKASDTAMYYCARGNWDDYWGQGTTVTVSS

SEQ ID NO: 156 - protein, 263 aa, Artificial Sequence
  source: /note="Description of Artificial Sequence: Synthetic scFv sequence"
MALPVTALLLPLALLLHAARPDVQLTQSPSFLSASVGDRVTITCRASKSISKDLAWYQQKPGKAPKLLIYSGSTLQSGVPSRFSGSGSGTEFTLTISSLQPEDFATYYCQQHNKYPYTFGGGTKVEIKGGGGSGGGGSGGGGSGGGGSQVQLVQSGAEVKKPGASVKVSCKASGYTFTSYWMNWVRQAPGQGLEWMGRIDPYDSETHYNQKFKDRVTMTVDKSTSTAYMELSSLRSEDTAVYYCARGNWDDYWGQGTTVTVSS

SEQ ID NO: 157 - protein, 263 aa, Artificial Sequence
  source: /note="Description of Artificial Sequence: Synthetic scFv sequence"
MALPVTALLLPLALLLHAARPDVQLTQSPSFLSASVGDRVTITCRASKSISKDLAWYQQKPGKAPKLLIYSGSTLQSGVPSRFSGSGSGTEFTLTISSLQPEDFATYYCQQHNKYPYTFGGGTKVEIKGGGGSGGGGSGGGGSGGGGSQVQLVQSGSELKKPGASVKVSCKASGYTFTSYWMNWVRQAPGQGLEWMGRIDPYDSETHYNQKFKDRFVFSVDKSVSTAYLQISSLKAEDTAVYYCARGNWDDYWGQGTTVTVSS

SEQ ID NO: 158 - protein, 263 aa, Artificial Sequence
  source: /note="Description of Artificial Sequence: Synthetic scFv sequence"
MALPVTALLLPLALLLHAARPDVVMTQSPAFLSVTPGEKVTITCRASKSISKDLAWYQQKPDQAPKLLIYSGSTLQSGVPSRFSGSGSGTDFTFTISSLEAEDAATYYCQQHNKYPYTFGGGTKVEIKGGGGSGGGGSGGGGSGGGGSEVQLVESGGGLVQPGGSLRLSCAASGYTFTSYWMNWVRQAPGKGLVWVSRIDPYDSETHYNQKFKDRFTISVDKAKSTAYLQMNSLRAEDTAVYYCARGNWDDYWGQGTTVTVSS

SEQ ID NO: 159 - protein, 263 aa, Artificial Sequence
  source: /note="Description of Artificial Sequence: Synthetic scFv sequence"
MALPVTALLLPLALLLHAARPDVVMTQSPAFLSVTPGEKVTITCRASKSISKDLAWYQQKPDQAPKLLIYSGSTLQSGVPSRFSGSGSGTDFTFTISSLEAEDAATYYCQQHNKYPYTFGGGTKVEIKGGGGSGGGGSGGGGSGGGGSEVQLVQSGAEVKKPGESLRISCKGSGYTFTSYWMNWVRQMPGKGLEWMGRIDPYDSETHYNQKFKDHVTISVDKSISTAYLQWSSLKASDTAMYYCARGNWDDYWGQGTTVTVSS

SEQ ID NO: 160 - protein, 263 aa, Artificial Sequence
  source: /note="Description of Artificial Sequence: Synthetic scFv sequence"
MALPVTALLLPLALLLHAARPDVVMTQSPAFLSVTPGEKVTITCRASKSISKDLAWYQQKPDQAPKLLIYSGSTLQSGVPSRFSGSGSGTDFTFTISSLEAEDAATYYCQQHNKYPYTFGGGTKVEIKGGGGSGGGGSGGGGSGGGGSQVQLVQSGAEVKKPGASVKVSCKASGYTFTSYWMNWVRQAPGQGLEWMGRIDPYDSETHYNQKFKDRVTMTVDKSTSTAYMELSSLRSEDTAVYYCARGNWDDYWGQGTTVTVSS

SEQ ID NO: 161 - protein, 263 aa, Artificial Sequence
  source: /note="Description of Artificial Sequence: Synthetic scFv sequence"
MALPVTALLLPLALLLHAARPDVVMTQSPAFLSVTPGEKVTITCRASKSISKDLAWYQQKPDQAPKLLIYSGSTLQSGVPSRFSGSGSGTDFTFTISSLEAEDAATYYCQQHNKYPYTFGGGTKVEIKGGGGSGGGGSGGGGSGGGGSQVQLVQSGSELKKPGASVKVSCKASGYTFTSYWMNWVRQAPGQGLEWMGRIDPYDSETHYNQKFKDRFVFSVDKSVSTAYLQISSLKAEDTAVYYCARGNWDDYWGQGTTVTVSS

SEQ ID NO: 162 - protein, 263 aa, Artificial Sequence
  source: /note="Description of Artificial Sequence: Synthetic scFv sequence"
MALPVTALLLPLALLLHAARPDVVMTQSPDSLAVSLGERATINCRASKSISKDLAWYQQKPGQPPKLLIYSGSTLQSGVPDRFSGSGSGTDFTLTISSLQAEDVAVYYCQQHNKYPYTFGGGTKVEIKGGGGSGGGGSGGGGSGGGGSEVQLVESGGGLVQPGGSLRLSCAASGYTFTSYWMNWVRQAPGKGLVWVSRIDPYDSETHYNQKFKDRFTISVDKAKSTAYLQMNSLRAEDTAVYYCARGNWDDYWGQGTTVTVSS

SEQ ID NO: 163 - protein, 263 aa, Artificial Sequence
  source: /note="Description of Artificial Sequence: Synthetic scFv sequence"
MALPVTALLLPLALLLHAARPDVVMTQSPDSLAVSLGERATINCRASKSISKDLAWYQQKPGQPPKLLIYSGSTLQSGVPDRFSGSGSGTDFTLTISSLQAEDVAVYYCQQHNKYPYTFGGGTKVEIKGGGGSGGGGSGGGGSGGGGSEVQLVQSGAEVKKPGESLRISCKGSGYTFTSYWMNWVRQMPGKGLEWMGRIDPYDSETHYNQKFKDHVTISVDKSISTAYLQWSSLKASDTAMYYCARGNWDDYWGQGTTVTVSS

SEQ ID NO: 164 - protein, 263 aa, Artificial Sequence
  source: /note="Description of Artificial Sequence: Synthetic scFv sequence"
MALPVTALLLPLALLLHAARPDVVMTQSPDSLAVSLGERATINCRASKSISKDLAWYQQKPGQPPKLLIYSGSTLQSGVPDRFSGSGSGTDFTLTISSLQAEDVAVYYCQQHNKYPYTFGGGTKVEIKGGGGSGGGGSGGGGSGGGGSQVQLVQSGAEVKKPGASVKVSCKASGYTFTSYWMNWVRQAPGQGLEWMGRIDPYDSETHYNQKFKDRVTMTVDKSTSTAYMELSSLRSEDTAVYYCARGNWDDYWGQGTTVTVSS

SEQ ID NO: 165 - protein, 263 aa, Artificial Sequence
  source: /note="Description of Artificial Sequence: Synthetic scFv sequence"
MALPVTALLLPLALLLHAARPDVVMTQSPDSLAVSLGERATINCRASKSISKDLAWYQQKPGQPPKLLIYSGSTLQSGVPDRFSGSGSGTDFTLTISSLQAEDVAVYYCQQHNKYPYTFGGGTKVEIKGGGGSGGGGSGGGGSGGGGSQVQLVQSGSELKKPGASVKVSCKASGYTFTSYWMNWVRQAPGQGLEWMGRIDPYDSETHYNQKFKDRFVFSVDKSVSTAYLQISSLKAEDTAVYYCARGNWDDYWGQGTTVTVSS

SEQ ID NO: 166 - protein, 282 aa, Artificial Sequence
  source: /note="Description of Artificial Sequence: Synthetic scFv sequence"
MALPVTALLLPLALLLHAARPEVKLVESGGGLVQPGGSLSLSCAASGFTFTDYYMSWVRQPPGKALEWLALIRSKADGYTTEYSASVKGRFTLSRDDSQSILYLQMNALRPEDSATYYCARDAAYYSYYSPEGAMDYWGQGTSVTVSSGGGGSGGGGSGGGGSMADYKDIVMTQSHKFMSTSVGDRVNITCKASQNVDSAVAWYQQKPGQSPKALIYSASYRYSGVPDRFTGRGSGTDFTLTISSVQAEDLAVYYCQQYYSTPWTFGGGTKLEIKRSDPTSS

SEQ ID NO: 167 - protein, 263 aa, Artificial Sequence
  source: /note="Description of Artificial Sequence: Synthetic scFv sequence"
MALPVTALLLPLALLLHAARPEVQLVESGGGLVQPGGSLRLSCAASGYTFTSYWMNWVRQAPGKGLVWVSRIDPYDSETHYNQKFKDRFTISVDKAKSTAYLQMNSLRAEDTAVYYCARGNWDDYWGQGTTVTVSSGGGGSGGGGSGGGGSGGGGSDVQLTQSPSFLSASVGDRVTITCRASKSISKDLAWYQQKPGKAPKLLIYSGSTLQSGVPSRFSGSGSGTEFTLTISSLQPEDFATYYCQQHNKYPYTFGGGTKVEIK

SEQ ID NO: 168 - protein, 263 aa, Artificial Sequence
  source: /note="Description of Artificial Sequence: Synthetic scFv sequence"
MALPVTALLLPLALLLHAARPEVQLVESGGGLVQPGGSLRLSCAASGYTFTSYWMNWVRQAPGKGLVWVSRIDPYDSETHYNQKFKDRFTISVDKAKSTAYLQMNSLRAEDTAVYYCARGNWDDYWGQGTTVTVSSGGGGSGGGGSGGGGSGGGGSDVVMTQSPAFLSVTPGEKVTITCRASKSISKDLAWYQQKPDQAPKLLIYSGSTLQSGVPSRFSGSGSGTDFTFTISSLEAEDAATYYCQQHNKYPYTFGGGTKVEIK

SEQ ID NO: 169 - protein, 263 aa, Artificial Sequence
  source: /note="Description of Artificial Sequence: Synthetic scFv sequence"
MALPVTALLLPLALLLHAARPEVQLVESGGGLVQPGGSLRLSCAASGYTFTSYWMNWVRQAPGKGLVWVSRIDPYDSETHYNQKFKDRFTISVDKAKSTAYLQMNSLRAEDTAVYYCARGNWDDYWGQGTTVTVSSGGGGSGGGGSGGGGSGGGGSDVVMTQSPDSLAVSLGERATINCRASKSISKDLAWYQQKPGQPPKLLIYSGSTLQSGVPDRFSGSGSGTDFTLTISSLQAEDVAVYYCQQHNKYPYTFGGGTKVEIK

SEQ ID NO: 170 - protein, 263 aa, Artificial Sequence
  source: /note="Description of Artificial Sequence: Synthetic scFv sequence"
MALPVTALLLPLALLLHAARPEVQLVESGGGLVQPGGSLRLSCAASGYTFTSYWMNWVRQAPGKGLVWVSRIDPYDSETHYNQKFKDRFTISVDKAKSTAYLQMNSLRAEDTAVYYCARGNWDDYWGQGTTVTVSSGGGGSGGGGSGGGGSGGGGSEVVLTQSPATLSLSPGERATLSCRASKSISKDLAWYQQKPGQAPRLLIYSGSTLQSGIPARFSGSGSGTDFTLTISSLEPEDFAVYYCQQHNKYPYTFGGGTKVEIK

SEQ ID NO: 171 - protein, 263 aa, Artificial Sequence
  source: /note="Description of Artificial Sequence: Synthetic scFv sequence"
MALPVTALLLPLALLLHAARPEVQLVQSGAEVKKPGESLRISCKGSGYTFTSYWMNWVRQMPGKGLEWMGRIDPYDSETHYNQKFKDHVTISVDKSISTAYLQWSSLKASDTAMYYCARGNWDDYWGQGTTVTVSSGGGGSGGGGSGGGGSGGGGSDVQLTQSPSFLSASVGDRVTITCRASKSISKDLAWYQQKPGKAPKLLIYSGSTLQSGVPSRFSGSGSGTEFTLTISSLQPEDFATYYCQQHNKYPYTFGGGTKVEIK

SEQ ID NO: 172 - protein, 263 aa, Artificial Sequence
  source: /note="Description of Artificial Sequence: Synthetic scFv sequence"
MALPVTALLLPLALLLHAARPEVQLVQSGAEVKKPGESLRISCKGSGYTFTSYWMNWVRQMPGKGLEWMGRIDPYDSETHYNQKFKDHVTISVDKSISTAYLQWSSLKASDTAMYYCARGNWDDYWGQGTTVTVSSGGGGSGGGGSGGGGSGGGGSDVVMTQSPAFLSVTPGEKVTITCRASKSISKDLAWYQQKPDQAPKLLIYSGSTLQSGVPSRFSGSGSGTDFTFTISSLEAEDAATYYCQQHNKYPYTFGGGTKVEIK

SEQ ID NO: 173 - protein, 263 aa, Artificial Sequence
  source: /note="Description of Artificial Sequence: Synthetic scFv sequence"
MALPVTALLLPLALLLHAARPEVQLVQSGAEVKKPGESLRISCKGSGYTFTSYWMNWVRQMPGKGLEWMGRIDPYDSETHYNQKFKDHVTISVDKSISTAYLQWSSLKASDTAMYYCARGNWDDYWGQGTTVTVSSGGGGSGGGGSGGGGSGGGGSDVVMTQSPDSLAVSLGERATINCRASKSISKDLAWYQQKPGQPPKLLIYSGSTLQSGVPDRFSGSGSGTDFTLTISSLQAEDVAVYYCQQHNKYPYTFGGGTKVEIK

SEQ ID NO: 174 - protein, 263 aa, Artificial Sequence
  source: /note="Description of Artificial Sequence: Synthetic scFv sequence"
MALPVTALLLPLALLLHAARPEVQLVQSGAEVKKPGESLRISCKGSGYTFTSYWMNWVRQMPGKGLEWMGRIDPYDSETHYNQKFKDHVTISVDKSISTAYLQWSSLKASDTAMYYCARGNWDDYWGQGTTVTVSSGGGGSGGGGSGGGGSGGGGSEVVLTQSPATLSLSPGERATLSCRASKSISKDLAWYQQKPGQAPRLLIYSGSTLQSGIPARFSGSGSGTDFTLTISSLEPEDFAVYYCQQHNKYPYTFGGGTKVEIK

SEQ ID NO: 175 - protein, 263 aa, Artificial Sequence
  source: /note="Description of Artificial Sequence: Synthetic scFv sequence"
MALPVTALLLPLALLLHAARPEVVLTQSPATLSLSPGERATLSCRASKSISKDLAWYQQKPGQAPRLLIYSGSTLQSGIPARFSGSGSGTDFTLTISSLEPEDFAVYYCQQHNKYPYTFGGGTKVEIKGGGGSGGGGSGGGGSGGGGSEVQLVESGGGLVQPGGSLRLSCAASGYTFTSYWMNWVRQAPGKGLVWVSRIDPYDSETHYNQKFKDRFTISVDKAKSTAYLQMNSLRAEDTAVYYCARGNWDDYWGQGTTVTVSS

SEQ ID NO: 176 - protein, 263 aa, Artificial Sequence
  source: /note="Description of Artificial Sequence: Synthetic scFv sequence"
MALPVTALLLPLALLLHAARPEVVLTQSPATLSLSPGERATLSCRASKSISKDLAWYQQKPGQAPRLLIYSGSTLQSGIPARFSGSGSGTDFTLTISSLEPEDFAVYYCQQHNKYPYTFGGGTKVEIKGGGGSGGGGSGGGGSGGGGSEVQLVQSGAEVKKPGESLRISCKGSGYTFTSYWMNWVRQMPGKGLEWMGRIDPYDSETHYNQKFKDHVTISVDKSISTAYLQWSSLKASDTAMYYCARGNWDDYWGQGTTVTVSS

SEQ ID NO: 177 - protein, 263 aa, Artificial Sequence
  source: /note="Description of Artificial Sequence: Synthetic scFv sequence"
MALPVTALLLPLALLLHAARPEVVLTQSPATLSLSPGERATLSCRASKSISKDLAWYQQKPGQAPRLLIYSGSTLQSGIPARFSGSGSGTDFTLTISSLEPEDFAVYYCQQHNKYPYTFGGGTKVEIKGGGGSGGGGSGGGGSGGGGSQVQLVQSGAEVKKPGASVKVSCKASGYTFTSYWMNWVRQAPGQGLEWMGRIDPYDSETHYNQKFKDRVTMTVDKSTSTAYMELSSLRSEDTAVYYCARGNWDDYWGQGTTVTVSS

SEQ ID NO: 178 - protein, 263 aa, Artificial Sequence
  source: /note="Description of Artificial Sequence: Synthetic scFv sequence"
MALPVTALLLPLALLLHAARPEVVLTQSPATLSLSPGERATLSCRASKSISKDLAWYQQKPGQAPRLLIYSGSTLQSGIPARFSGSGSGTDFTLTISSLEPEDFAVYYCQQHNKYPYTFGGGTKVEIKGGGGSGGGGSGGGGSGGGGSQVQLVQSGSELKKPGASVKVSCKASGYTFTSYWMNWVRQAPGQGLEWMGRIDPYDSETHYNQKFKDRFVFSVDKSVSTAYLQISSLKAEDTAVYYCARGNWDDYWGQGTTVTVSS

SEQ ID NO: 179 - protein, 263 aa, Artificial Sequence
  source: /note="Description of Artificial Sequence: Synthetic scFv sequence"
MALPVTALLLPLALLLHAARPQVQLVQSGAEVKKPGASVKVSCKASGYTFTSYWMNWVRQAPGQGLEWMGRIDPYDSETHYNQKFKDRVTMTVDKSTSTAYMELSSLRSEDTAVYYCARGNWDDYWGQGTTVTVSSGGGGSGGGGSGGGGSGGGGSDVQLTQSPSFLSASVGDRVTITCRASKSISKDLAWYQQKPGKAPKLLIYSGSTLQSGVPSRFSGSGSGTEFTLTISSLQPEDFATYYCQQHNKYPYTFGGGTKVEIK

SEQ ID NO: 180 - protein, 263 aa, Artificial Sequence
  source: /note="Description of Artificial Sequence: Synthetic scFv sequence"
MALPVTALLLPLALLLHAARPQVQLVQSGAEVKKPGASVKVSCKASGYTFTSYWMNWVRQAPGQGLEWMGRIDPYDSETHYNQKFKDRVTMTVDKSTSTAYMELSSLRSEDTAVYYCARGNWDDYWGQGTTVTVSSGGGGSGGGGSGGGGSGGGGSDVVMTQSPAFLSVTPGEKVTITCRASKSISKDLAWYQQKPDQAPKLLIYSGSTLQSGVPSRFSGSGSGTDFTFTISSLEAEDAATYYCQQHNKYPYTFGGGTKVEIK

SEQ ID NO: 181 - protein, 263 aa, Artificial Sequence
  source: /note="Description of Artificial Sequence: Synthetic scFv sequence"
MALPVTALLLPLALLLHAARPQVQLVQSGAEVKKPGASVKVSCKASGYTFTSYWMNWVRQAPGQGLEWMGRIDPYDSETHYNQKFKDRVTMTVDKSTSTAYMELSSLRSEDTAVYYCARGNWDDYWGQGTTVTVSSGGGGSGGGGSGGGGSGGGGSDVVMTQSPDSLAVSLGERATINCRASKSISKDLAWYQQKPGQPPKLLIYSGSTLQSGVPDRFSGSGSGTDFTLTISSLQAEDVAVYYCQQHNKYPYTFGGGTKVEIK

SEQ ID NO: 182 - protein, 263 aa, Artificial Sequence
  source: /note="Description of Artificial Sequence: Synthetic scFv sequence"
MALPVTALLLPLALLLHAARPQVQLVQSGAEVKKPGASVKVSCKASGYTFTSYWMNWVRQAPGQGLEWMGRIDPYDSETHYNQKFKDRVTMTVDKSTSTAYMELSSLRSEDTAVYYCARGNWDDYWGQGTTVTVSSGGGGSGGGGSGGGGSGGGGSEVVLTQSPATLSLSPGERATLSCRASKSISKDLAWYQQKPGQAPRLLIYSGSTLQSGIPARFSGSGSGTDFTLTISSLEPEDFAVYYCQQHNKYPYTFGGGTKVEIK

SEQ ID NO: 183 - protein, 263 aa, Artificial Sequence
  source: /note="Description of Artificial Sequence: Synthetic scFv sequence"
MALPVTALLLPLALLLHAARPQVQLVQSGSELKKPGASVKVSCKASGYTFTSYWMNWVRQAPGQGLEWMGRIDPYDSETHYNQKFKDRFVFSVDKSVSTAYLQISSLKAEDTAVYYCARGNWDDYWGQGTTVTVSSGGGGSGGGGSGGGGSGGGGSDVQLTQSPSFLSASVGDRVTITCRASKSISKDLAWYQQKPGKAPKLLIYSGSTLQSGVPSRFSGSGSGTEFTLTISSLQPEDFATYYCQQHNKYPYTFGGGTKVEIK

SEQ ID NO: 184 - protein, 263 aa, Artificial Sequence
  source: /note="Description of Artificial Sequence: Synthetic scFv sequence"
MALPVTALLLPLALLLHAARPQVQLVQSGSELKKPGASVKVSCKASGYTFTSYWMNWVRQAPGQGLEWMGRIDPYDSETHYNQKFKDRFVFSVDKSVSTAYLQISSLKAEDTAVYYCARGNWDDYWGQGTTVTVSSGGGGSGGGGSGGGGSGGGGSDVVMTQSPAFLSVTPGEKVTITCRASKSISKDLAWYQQKPDQAPKLLIYSGSTLQSGVPSRFSGSGSGTDFTFTISSLEAEDAATYYCQQHNKYPYTFGGGTKVEIK

SEQ ID NO: 185 - protein, 263 aa, Artificial Sequence
  source: /note="Description of Artificial Sequence: Synthetic scFv sequence"
MALPVTALLLPLALLLHAARPQVQLVQSGSELKKPGASVKVSCKASGYTFTSYWMNWVRQAPGQGLEWMGRIDPYDSETHYNQKFKDRFVFSVDKSVSTAYLQISSLKAEDTAVYYCARGNWDDYWGQGTTVTVSSGGGGSGGGGSGGGGSGGGGSDVVMTQSPDSLAVSLGERATINCRASKSISKDLAWYQQKPGQPPKLLIYSGSTLQSGVPDRFSGSGSGTDFTLTISSLQAEDVAVYYCQQHNKYPYTFGGGTKVEIK

SEQ ID NO: 186 - protein, 263 aa, Artificial Sequence
  source: /note="Description of Artificial Sequence: Synthetic scFv sequence"
MALPVTALLLPLALLLHAARPQVQLVQSGSELKKPGASVKVSCKASGYTFTSYWMNWVRQAPGQGLEWMGRIDPYDSETHYNQKFKDRFVFSVDKSVSTAYLQISSLKAEDTAVYYCARGNWDDYWGQGTTVTVSSGGGGSGGGGSGGGGSGGGGSEVVLTQSPATLSLSPGERATLSCRASKSISKDLAWYQQKPGQAPRLLIYSGSTLQSGIPARFSGSGSGTDFTLTISSLEPEDFAVYYCQQHNKYPYTFGGGTKVEIK

SEQ ID NO: 187 - protein, 245 aa, Artificial Sequence
  source: /note="Description of Artificial Sequence: Synthetic scFv sequence"
QVQLQQSGAEVKKSGASVKVSCKASGYTFTDYYMHWLRQAPGQGLEWMGWINPNSGDTNYAQKFQGRVTLTRDTSISTVYMELSRLRSDDTAVYYCARDMNILATVPFDIWGQGTMVTVSSASGGGGSGGRASGGGGSDIQMTQSPSSLSASVGDRVTITCRASQSISSYLNWYQQKPGKAPKLLIYAASSLQSGVPSRFSGSGSGTDFTLTISSLQPEDFATYYCQQGDSVPLTFGGGTKVEIK

SEQ ID NO: 188 - protein, 243 aa, Artificial Sequence
  source: /note="Description of Artificial Sequence: Synthetic scFv sequence"
QVQLVQSGAEVKKPGASVKVSCKASGYIFTGYYIHWVRQAPGQGLEWMGWINPNSGGTNYAQKFQGRVTMTRDTSISTAYMELSGLRSDDPAVYYCARDMNILATVPFDIWGQGTLVTVSSGGGGSGGGGSGGGGSDIQLTQSPSSLSASVGDRVTITCRASQSISSYLNWYQQKPGKAPKLLIYAASSLQSGVPSRFSGSGSGTDFTLTVNSLQPEDFATYYCQQGDSVPLTFGGGTKVEIK

SEQ ID NO: 189 - protein, 243 aa, Artificial Sequence
  source: /note="Description of Artificial Sequence: Synthetic scFv sequence"
QVQLVQSGAEVKKPGASVKVSCKASGYTFTGYYMHWVRQAPGQGLEWMGWINPNSGGTNYAQKFQGRVTLTRDTSISTVYMELSRLRSDDTAVYYCARDMNILATVPFDIWGQGTMVTVSSGGGGSGGGGSGGGGSDIQMTQSPSSLSASVGDRVTITCRASQSISSYLNWYQQKPGKAPKLLIYAASSLQSGVPSRFSGSGSGTDFTLTVNSLQPEDFATYYCQQGDSVPLTFGGGTRLEIK

SEQ ID NO: 190 - protein, 243 aa, Artificial Sequence
  source: /note="Description of Artificial Sequence: Synthetic scFv sequence"
QVQLVQSGAEVKKPGASVKVSCKASGYTFTGYYMHWVRQAPGQGLEWMGWINPNSGGTNYAQKFQGRVTMTRDTSISTAYMELSRLRSDDTAVYYCARDMNILATVPFDIWGQGTMVTVSSGGGGSGGGGSGGGGSDIQMTQSPSSLSASVGDRVTITCRASQSISTYLNWYQQKPGKAPNLLIYAAFSLQSGVPSRFSGSGSGTDFTLTINSLQPEDFATYYCQQGDSVPLTFGGGTKLEIK

SEQ ID NO: 191 - protein, 264 aa, Artificial Sequence
  source: /note="Description of Artificial Sequence: Synthetic scFv sequence"
MALPVTALLLPLALLLHAARPQVQLVQSGAEVKKPGASVKVSCKASGYTFTGYYMHWVRQAPGQGLEWMGWINPNSGGTNYAQKFQGRVTMTRDTSISTAYMELSRLRSDDTAVYYCARDMNILATVPFDIWGQGTMVTVSSGGGGSGGGGSGGGGSDIQMTQSPSSLSASVGDRVTITCRASQSISTYLNWYQQKPGKAPNLLIYAAFSLQSGVPSRFSGSGSGTDFTLTINSLQPEDFATYYCQQGDSVPLTFGGGTKLEIK

SEQ ID NO: 192 - protein, 264 aa, Artificial Sequence
  source: /note="Description of Artificial Sequence: Synthetic scFv sequence"
MALPVTALLLPLALLLHAARPQVQLVQSGAEVKKPGASVKVSCKASGYTFTGYYMHWVRQAPGQGLEWMGWINPNSGGTNYAQKFQGRVTLTRDTSISTVYMELSRLRSDDTAVYYCARDMNILATVPFDIWGQGTMVTVSSGGGGSGGGGSGGGGSDIQMTQSPSSLSASVGDRVTITCRASQSISSYLNWYQQKPGKAPKLLIYAASSLQSGVPSRFSGSGSGTDFTLTVNSLQPEDFATYYCQQGDSVPLTFGGGTRLEIK

SEQ ID NO: 193 - protein, 264 aa, Artificial Sequence
  source: /note="Description of Artificial Sequence: Synthetic scFv sequence"
MALPVTALLLPLALLLHAARPQVQLVQSGAEVKKPGASVKVSCKASGYIFTGYYIHWVRQAPGQGLEWMGWINPNSGGTNYAQKFQGRVTMTRDTSISTAYMELSGLRSDDPAVYYCARDMNILATVPFDIWGQGTLVTVSSGGGGSGGGGSGGGGSDIQLTQSPSSLSASVGDRVTITCRASQSISSYLNWYQQKPGKAPKLLIYAASSLQSGVPSRFSGSGSGTDFTLTVNSLQPEDFATYYCQQGDSVPLTFGGGTKVEIK

SEQ ID NO: 194 - protein, 266 aa, Artificial Sequence
  source: /note="Description of Artificial Sequence: Synthetic scFv sequence"
MALPVTALLLPLALLLHAARPQVQLQQSGAEVKKSGASVKVSCKASGYTFTDYYMHWLRQAPGQGLEWMGWINPNSGDTNYAQKFQGRVTLTRDTSISTVYMELSRLRSDDTAVYYCARDMNILATVPFDIWGQGTMVTVSSASGGGGSGGRASGGGGSDIQMTQSPSSLSASVGDRVTITCRASQSISSYLNWYQQKPGKAPKLLIYAASSLQSGVPSRFSGSGSGTDFTLTISSLQPEDFATYYCQQGDSVPLTFGGGTKVEIK

SEQ ID NO: 195 - protein, 249 aa, Artificial Sequence
  source: /note="Description of Artificial Sequence: Synthetic scFv sequence"
DIVLTQSPDSLAVSLGERATINCRASESVDNYGNTFMHWYQQKPGQPPKLLIYRASNLESGVPDRFSGSGSRTDIFITISSLQAEDVAVYYCQQSNEDPPTFGQGTKLEIKGGGGSGGGGSGGGGSGGGGSQIQLVQSGSELKKPGASVKVSCKASGYIFTNYGMNWVRQAPGQGLEWMGWINTYTGESTYSADFKGRFVFSLDTSVSTAYLQINALKAEDTAVYYCARSGGYDPMDYWGQGTTVTVSS

SEQ ID NO: 196 - protein, 249 aa, Artificial Sequence
  source: /note="Description of Artificial Sequence: Synthetic scFv sequence"
DIVLTQSPDSLAVSLGERATINCRASESVDNYGNTFMHWYQQKPGQPPKLLIYRASNLESGVPDRFSGSGSRTDFTLTISSLQAEDVAVYYCQQSNEDPPTFGQGTKLEIKGGGGSGGGGSGGGGSGGGGSQIQLVQSGAEVKKPGASVKVSCKASGYIFTNYGMNWVRQAPGQRLEWMGWINTYTGESTYSADFKGRVTITLDTSASTAYMELSSLRSEDTAVYYCARSGGYDPMDYWGQGTTVTVSS

SEQ ID NO: 197 - protein, 249 aa, Artificial Sequence
  source: /note="Description of Artificial Sequence: Synthetic scFv sequence"
EIVLTQSPATLSLSPGERATLSCRASESVDNYGNTFMHWYQQKPGQAPRLLIYRASNLESGIPARFSGSGSRTDFTLTISSLEPEDVAVYYCQQSNEDPPTFGQGTKLEIKGGGGSGGGGSGGGGSGGGGSQIQLVQSGSELKKPGASVKVSCKASGYIFTNYGMNWVRQAPGQGLEWMGWINTYTGESTYSADFKGRFVFSLDTSVSTAYLQINALKAEDTAVYYCARSGGYDPMDYWGQGTTVTVSS

SEQ ID NO: 198 - protein, 249 aa, Artificial Sequence
  source: /note="Description of Artificial Sequence: Synthetic scFv sequence"
EIVLTQSPATLSLSPGERATLSCRASESVDNYGNTFMHWYQQKPGQAPRLLIYRASNLESGIPARFSGSGSRTDFTLTISSLEPEDVAVYYCQQSNEDPPTFGQGTKLEIKGGGGSGGGGSGGGGSGGGGSQIQLVQSGAEVKKPGASVKVSCKASGYIFTNYGMNWVRQAPGQRLEWMGWINTYTGESTYSADFKGRVTITLDTSASTAYMELSSLRSEDTAVYYCARSGGYDPMDYWGQGTTVTVSS

SEQ ID NO: 199 - protein, 249 aa, Artificial Sequence
  source: /note="Description of Artificial Sequence: Synthetic scFv sequence"
QIQLVQSGSELKKPGASVKVSCKASGYIFTNYGMNWVRQAPGQGLEWMGWINTYTGESTYSADFKGRFVFSLDTSVSTAYLQINALKAEDTAVYYCARSGGYDPMDYWGQGTTVTVSSGGGGSGGGGSGGGGSGGGGSDIVLTQSPDSLAVSLGERATINCRASESVDNYGNTFMHWYQQKPGQPPKLLIYRASNLESGVPDRFSGSGSRTDFTLTISSLQAEDVAVYYCQQSNEDPPTFGQGTKLEIK

SEQ ID NO: 200 - protein, 249 aa, Artificial Sequence
  source: /note="Description of Artificial Sequence: Synthetic scFv sequence"
QIQLVQSGSELKKPGASVKVSCKASGYIFTNYGMNWVRQAPGQGLEWMGWINTYTGESTYSADFKGRFVFSLDTSVSTAYLQINALKAEDTAVYYCARSGGYDPMDYWGQGTTVTVSSGGGGSGGGGSGGGGSGGGGSEIVLTQSPATLSLSPGERATLSCRASESVDNYGNTFMHWYQQKPGQAPRLLIYRASNLESGIPARFSGSGSRTDFTLTISSLEPEDVAVYYCQQSNEDPPTFGQGTKLEIK

SEQ ID NO: 201 - protein, 249 aa, Artificial Sequence
  source: /note="Description of Artificial Sequence: Synthetic scFv sequence"
QIQLVQSGAEVKKPGASVKVSCKASGYIFTNYGMNWVRQAPGQRLEWMGWINTYTGESTYSADFKGRVTITLDTSASTAYMELSSLRSEDTAVYYCARSGGYDPMDYWGQGTTVTVSSGGGGSGGGGSGGGGSGGGGSDIVLTQSPDSLAVSLGERATINCRASESVDNYGNTFMHWYQQKPGQPPKLLIYRASNLESGVPDRFSGSGSRTDFTLTISSLQAEDVAVYYCQQSNEDPPTFGQGTKLEIK

SEQ ID NO: 202 - protein, 249 aa, Artificial Sequence
  source: /note="Description of Artificial Sequence: Synthetic scFv sequence"
QIQLVQSGAEVKKPGASVKVSCKASGYIFTNYGMNWVRQAPGQRLEWMGWINTYTGESTYSADFKGRVTITLDTSASTAYMELSSLRSEDTAVYYCARSGGYDPMDYWGQGTTVTVSSGGGGSGGGGSGGGGSGGGGSEIVLTQSPATLSLSPGERATLSCRASESVDNYGNTFMHWYQQKPGQAPRLLIYRASNLESGIPARFSGSGSRTDFTLTISSLEPEDVAVYYCQQSNEDPPTFGQGTKLEIK

SEQ ID NO: 203 - protein, 247 aa, Artificial Sequence
  source: /note="Description of Artificial Sequence: Synthetic scFv sequence"
DIQMTQSTSSLSASLGDRVTISCSASQGINNYLNWYQQKPDGTVELLIYYTSTLQSGVPSRFSGSGSGTDYSLTISNLEPEDIGTYYCQQYSKLPRTFGGGTKLEIKGSTSGSGKPGSSEGSTKGQVQLQQSGSELMMPGASVKISCKATGYTFSNYWIEWVKQRPGHGLEWIGEILPGTGRTIYNEKFKGKATFTADISSNTVQMQLSSLTSEDSAVYYCARRDYYGNFYYAMDYWGQGTSVTVSS

SEQ ID NO: 204 - protein, 242 aa, Artificial Sequence
  source: /note="Description of Artificial Sequence: Synthetic scFv sequence"
DIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSS

SEQ ID NO: 205 - DNA, 726 bp, Artificial Sequence
  source: /note="Description of Artificial Sequence: Synthetic scFv sequence"
gacatccagatgacacagaccacaagctccctgtccgcctctctgggcgacagagtgaccatcagctgccgggcctcccaggatatctctaagtatctgaactggtaccagcagaagcccgatggcacagtgaagctgctgatctatcacaccagccgcctgcactccggagtgccttctaggttcagcggctccggctctggcacagactacagcctgaccatctccaacctggagcaggaggatatcgccacctatttctgccagcagggcaatacactgccttacacctttggcggcggcacaaagctggagatcaccggaggaggaggcagcggaggaggaggctccggcggcggcggctctgaggtgaagctgcaggagtccggaccaggcctggtggcacctagccagtccctgtctgtgacatgtaccgtgtccggcgtgtctctgccagactacggcgtgtcttggatcaggcagccacctaggaagggcctggagtggctgggcgtgatctggggcagcgagacaacatactataattctgccctgaagagcagactgacaatcatcaaggacaacagcaagtcccaggtgttcctgaagatgaatagcctgcagacagacgataccgccatctactattgcgccaagcactactattacggcggcagctatgccatggattactggggccagggcacatccgtgaccgtgtctagc

SEQ ID NO: 206 - DNA, 726 bp, Artificial Sequence
  source: /note="Description of Artificial Sequence: Synthetic scFv sequence"
gacatccagatgacacagaccacaagctccctgagcgcctccctgggcgacagagtgaccatctcttgccgggccagccaggatatctccaagtatctgaactggtaccagcagaagcccgatggcacagtgaagctgctgatctatcacacctctcgcctgcacagcggcgtgccttccaggttctctggcagcggctccggcacagactactctctgaccatcagcaacctggagcaggaggatatcgccacctatttctgccagcagggcaatacactgccctacacctttggcggcggcacaaagctggagatcaccggcggcggcggctctggaggaggaggcagcggcggaggaggctccgaggtgaagctgcaggagtccggaccaggcctggtggcaccatctcagagcctgtccgtgacatgtaccgtgagcggcgtgtccctgcctgactacggcgtgagctggatcagacagccacctaggaagggcctggagtggctgggcgtgatctggggctccgagacaacatactataactccgccctgaagtctcggctgaccatcatcaaggacaactctaagagccaggtgttcctgaagatgaattccctgcagacagacgataccgccatctactattgcgccaagcactactattacggcggctcctatgccatggattactggggccagggcacatctgtgaccgtgtctagc

SEQ ID NO: 207 - DNA, 726 bp, Artificial Sequence
  source: /note="Description of Artificial Sequence: Synthetic scFv sequence"
gacatccagatgacacagaccacaagctccctgagcgcctccctgggcgacagagtgaccatcagctgccgggcctcccaggatatctctaagtatctgaactggtaccagcagaagccagatggcacagtgaagctgctgatctatcacaccagccgcctgcactccggagtgccctctaggttctctggcagcggctccggcacagactacagcctgaccatctccaacctggagcaggaggatatcgccacctatttctgccagcagggcaatacactgccatacacctttggcggcggcacaaagctggagatcaccggaggaggaggcagcggaggaggaggctccggcggcggcggctctgaggtgaagctgcaggagtccggaccaggcctggtggcaccttctcagagcctgtccgtgacatgtaccgtgtctggcgtgagcctgcccgactacggcgtgtcttggatcagacagccacctaggaagggcctggagtggctgggcgtgatctggggcagcgagacaacatactataattctgccctgaagagcaggctgaccatcatcaaggacaactctaagagccaggtgttcctgaagatgaattccctgcagacagacgataccgccatctactattgcgccaagcactactattacggcggctcttatgccatggattactggggccagggcacaagcgtgaccgtgtctagc

SEQ ID NO: 208 - DNA, 726 bp, Artificial Sequence
  source: /note="Description of Artificial Sequence: Synthetic scFv sequence"
gacatccagatgacacagaccacaagctccctgagcgcctccctgggcgacagagtgaccatctcttgccgggccagccaggatatctccaagtatctgaactggtaccagcagaagccagatggcacagtgaagctgctgatctatcacacctctcgcctgcacagcggagtgccctccaggttctctggcagcggctccggcacagactactctctgaccatcagcaacctggagcaggaggatatcgccacctatttctgccagcagggcaatacactgccctacacctttggcggcggcacaaagctggagatcaccggcggcggcggctctggaggaggaggcagcggcggaggaggctccgaggtgaagctgcaggagtccggaccaggcctggtggcaccatctcagagcctgtccgtgacatgtaccgtgagcggcgtgtccctgcctgactacggcgtgagctggatcagacagccacctaggaagggcctggagtggctgggcgtgatctggggctccgagacaacatactataattccgccctgaagtctcggctgacaatcatcaaggacaactctaagagccaggtgtttctgaagatgaatagcctgcagacagacgataccgccatctactattgcgccaagcactactattacggcggctcctatgccatggattactggggccagggcacatctgtgaccgtgtctagc

SEQ ID NO: 209 - DNA, 726 bp, Artificial Sequence
  source: /note="Description of Artificial Sequence: Synthetic scFv sequence"
gacatccagatgacacagaccacaagctccctgagcgcctccctgggcgacagagtgaccatcagctgccgggcctcccaggatatctctaagtatctgaactggtaccagcagaagccagatggcacagtgaagctgctgatctatcacaccagccgcctgcactccggagtgccctctaggttctctggcagcggctccggcacagactacagcctgaccatctccaacctggagcaggaggatatcgccacctatttctgccagcagggcaatacactgccatacacctttggcggcggcacaaagctggagatcaccggaggaggaggcagcggaggaggaggctccggcggcggcggctctgaggtgaagctgcaggagtccggaccaggcctggtggcaccttctcagagcctgtccgtgacatgtaccgtgtctggcgtgagcctgcccgactacggcgtgtcttggatcagacagccacctaggaagggcctggagtggctgggcgtgatctggggcagcgagacaacatactataattctgccctgaagagcaggctgacaatcatcaaggacaactctaagagccaggtgtttctgaagatgaatagcctgcagacagacgataccgccatctactattgtgccaagcactactattacggcggcagctatgccatggattactggggccagggcacatccgtgaccgtgtctagc

SEQ ID NO: 210 - DNA, 726 bp, Artificial Sequence
  source: /note="Description of Artificial Sequence: Synthetic scFv sequence"
gacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctca

SEQ ID NO: 211 - DNA, 726 bp, Artificial Sequence
  source: /note="Description of Artificial Sequence: Synthetic scFv sequence"
gatatccagatgacacagaccacaagctccctgtccgcctctctgggcgacagagtgaccatcagctgccgggcctcccaggatatctctaagtatctgaactggtaccagcagaagcccgatggcacagtgaagctgctgatctatcacaccagccgcctgcactccggagtgccttctaggttcagcggctccggctctggcacagactacagcctgaccatctccaacctggagcaggaggatatcgccacctatttctgccagcagggcaatacactgccttacacctttggcggcggcacaaagctggagatcaccggaggaggaggcagcggaggaggaggctccggcggcggcggctctgaggtgaagctgcaggagtccggaccaggcctggtggcacctagccagtccctgtctgtgacatgtaccgtgtccggcgtgtctctgccagactacggcgtgtcttggatcaggcagccacctaggaagggcctggagtggctgggcgtgatctggggcagcgagacaacatactataattctgccctgaagagcagactgacaatcatcaaggacaacagcaagtcccaggtgttcctgaagatgaatagcctgcagacagacgataccgccatctactattgcgccaagcactactattacggcggcagctatgccatggattactggggccagggcacatccgtgaccgtgtctagc

SEQ ID NO: 212 - protein, 247 aa, Artificial Sequence
  source: /note="Description of Artificial Sequence: Synthetic scFv sequence"
DIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGSGSGNWSHPQFEKGSGSGEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSS

SEQ ID NO: 213 - protein, 245 aa, Artificial Sequence
  source: /note="Description of Artificial Sequence: Synthetic scFv sequence"
DIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGSTSGSGKPGSGEGSTKGEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSS

SEQ ID NO: 214 - protein, 439 aa, Artificial Sequence
  source: /note="Description of Artificial Sequence: Synthetic scFv sequence"
DIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGSTSGSGKPGSGEGSTKGEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSESKYGPPCPPCPMFWVLVVVGGVLACYSLLVTVAFIIFWVKRGRKKLLYIFKQPFMRPVQTTQEEDGCSCRFEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRL

SEQ ID NO: 215 - protein, 250 aa, Artificial Sequence
  source: /note="Description of Artificial Sequence: Synthetic scFv sequence"
DIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITKAGGGGSGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSD

SEQ ID NO: 216 - protein, 438 aa, Artificial Sequence
  source: /note="Description of Artificial Sequence: Synthetic scFv sequence"
DIQMTQTTSSLSASLGDRVTISCRASQDISKYLNWYQQKPDGTVKLLIYHTSRLHSGVPSRFSGSGSGTDYSLTISNLEQEDIATYFCQQGNTLPYVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 217 - protein, 247 aa, Artificial Sequence
  source: /note="Description of Artificial Sequence: Synthetic scFv sequence"
EIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSGGGGSQVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSS

SEQ ID NO: 218 - protein, 247 aa, Artificial Sequence
  source: /note="Description of Artificial Sequence: Synthetic scFv sequence"
EIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSGGGGSQVQLQESGPGLVKPSETLSLTCTVSGVSLPDYGVSWIRQPPGKGLEWIGVIWGSETTYYSSSLKSRVTISKDNSKNQVSLKLSSVTAADTAVYYCAKHYYYGGSYAMDYWGQGTLVTVSS

SEQ ID NO: 219 - protein, 251 aa, Artificial Sequence
  source: /note="Description of Artificial Sequence: Synthetic scFv sequence"
EVQLQQSGPELIKPGASVKMSCKASGYTFTSYVMHWVKQKPGQGLEWIGYINPYNDGTKYNEKFKGKATLTSDKSSSTAYMELSSLTSEDSAVYYCARGTYYYGSRVFDYWGQGTTLTVSSGGGGSGGGGSGGGGSDIVMTQAAPSIPVTPGESVSISCRSSKSLLNSNGNTYLYWFLQRPGQSPQLLIYRMSNLASGVPDRFSGSGSGTAFTLRISRVEAEDVGVYYCMQHLEYPFTFGAGTKLELKRAD

SEQ ID NO: 220 - protein, 252 aa, Artificial Sequence
  source: /note="Description of Artificial Sequence: Synthetic scFv sequence"
EVQLQQSGPELIKPGASVKMSCKASGYTFTSYVMHWVKQKPGQGLEWIGYINPYNDGTKYNEKFKGKATLTSDKSSSTAYMELSSLTSEDSAVYYCARGTYYYGSRVFDYWGQGTTLTVSSGGGGSGGGGSGGGGSDIVMTQAAPSIPVTPGESVSISCRSSKSLLNSNGNTYLYWFLQRPGQSPQLLIYRMSNLASGVPDRFSGSGSGTAFTLRISRVEAEDVGVYYCMQHLEYPFTFGAGTKLELKRSDP

SEQ ID NO: 221 - protein, 251 aa, Artificial Sequence
  source: /note="Description of Artificial Sequence: Synthetic scFv sequence"
EVQLVESGGGLVQPGRSLRLSCAASGFTFDDYAMHWVRLAPGKGLEWVSGISWNSGRIGYADSVKGRFTISRDNAKNSLFLQMNSLRAKDTAVYYCARDQGYHYYDSAEHAFDIWGQGTMVTVSSGGGGSGGGGSGGGGSQSVLTQPRSVSGSPGQSVTISCTGPISGVGDYTSVSWYQHYPGKTPKLIIYDVTQRPSGVPNRFSGSKSGNTASLTISGLQADDEADYYCCSYEAPTHTYVFGTGTKLTVL

SEQ ID NO: 222 - protein, 251 aa, Artificial Sequence
  source: /note="Description of Artificial Sequence: Synthetic scFv sequence"
EVQLVESGGGLVQPGRSLRLSCAASGFTFDDYAMHWVRQAPGKGLEWVSGISWNSGRIGYADSVKGRFTISRDNAKNSLFLQMNSLRAEDTAVYYCARDQGYHYYDSAEHAFDIWGQGTMVTVSSGGGGSGGGGSGGGGSQAVLTQPRSVSGSPGQSVTISCTGISSGVDSHRYVSWYQHHPGKAPKLMIYDFSKRPSGVPDRFSGSKSGNTASLTISGLQAEDEADYYCCSYAAISPNYVFGTGTKLTVL

SEQ ID NO: 223 - protein, 251 aa, Artificial Sequence
  source: /note="Description of Artificial Sequence: Synthetic scFv sequence"
EVQLVESGGGLVQPGRSLRLSCAASGFTFDDYAMHWVRQAPGKGLEWVSGISWNSGRIGYADSVKGRFTISRDNAKNSLFLQMNSLRAEDTAVYYCARDQGYHYYDSAEHAFDIWGQGTMVTVSSGGGGSGGGGSGGGGSQLVLTQPPSVSGSPGQSVTFSCTGASSDVGGYDHVSWYQHHPGKGPKLLIYDVSKRPSGVPDRFSGSKSGNTASLTISGLQAEDEADYYCCSFAGYYTYWLFGGGTKVTVL

SEQ ID NO: 224 - protein, 250 aa, Artificial Sequence
  source: /note="Description of Artificial Sequence: Synthetic scFv sequence"
EVQLVESGGGLVQPGRSLRLSCAASGFTFDDYAMHWVRQAPGKGLEWVSGISWNSGRIGYADSVKGRFTISRDNAKNSLFLQMNSLRAEDTAVYYCARDQGYHYYDSAEHAFDIWGQGTMVTVSSGGGGSGGGGSGGGGSQSALTQPASVSGSPGQSITIFCTGTSSDVGGYNYVSWYQQLPGTAPKLLIYSNNQRPSGVPDRFSGSKSGTSASLAISGLRSEDEADYYCAAWDDSLSVVFGGGTKLTVL

SEQ ID NO: 225 - protein, 251 aa, Artificial Sequence
  source: /note="Description of Artificial Sequence: Synthetic scFv sequence"
EVQLVESGGGLVQPGRSLRLSCAASGFTFDDYAMHWVRQAPGKGLEWVSGISWNSGRIGYADSVKGRFTISRDNAKNSLFLQMNSLRAEDTAVYYCARDQGYHYYDSAEHAFDIWGQGTMVTVSSGGGGSGGGGSGGGGSQSALTQPASVSGSPGQSITISCTGTSSDVGAYNFVSWYQQLPGTAPKFLIYDNNKRPPGIPDRFSGSKSGTSATLGITGLQTGDEADYYCATWDSGLSAVVFGGGTKLTVL

SEQ ID NO: 226 - protein, 248 aa, Artificial Sequence
  source: /note="Description of Artificial Sequence: Synthetic scFv sequence"
EVQLVESGGGLVQPGRSLRLSCAASGFTFDDYAMHWVRQAPGKGLEWVSGISWNSGRIGYADSVKGRFTISRDNAKNSLFLQMNSLRAEDTAVYYCARDQGYHYYDSAEHAFDIWGQGTMVTVSSGGGGSGGGGSGGGGSSYELTQDPAVSVALGQTVRITCQGDSLRSYYASWYQQKPGQAPVLVIYDKNNRPSGIPDRFSGSSSGNTASLTITGAQAEDEADYYCNSRDSSGNNWVFGGGTKLTVL

SEQ ID NO: 227 - protein, 236 aa, Artificial Sequence
  source: /note="Description of Artificial Sequence: Synthetic scFv sequence"
EVQLVESGGGLVQPGRSLRLSCAASGFTFDDYAMHWVRQAPGKGLEWVSGISWNSGRIGYADSVKGRFTISRDNAKNSLFLQMNSLRAEDTAVYYCARDQGYHYYDSAEHAFDIWGQGTMVTVSSQSVLTQPRSLSGSPGQSVTIACTGASTDVGGYNYVSWYQQHPGKAPKLMIYDVNKRPSGVPDRFSGSKSGNTAFLTISGLQAEDEADYYCCSYAGSYTFEVFGGGTKLTVL

SEQ ID NO: 228 - protein, 252 aa, Artificial Sequence
  source: /note="Description of Artificial Sequence: Synthetic scFv sequence"
EVQLVESGGGLVQPGRSLRLSCAASGFTFDDYAMHWVRQAPGKGLEWVSGISWNSGRIGYADSVKGRFTISRDNAKNSLFLQMNSLRAEDTAVYYCARDQGYHYYDSAEHAFDIWGQGTVVTVSSGGGGSGGGGSGGGGSQSALTQPASVSGSPGQSITISCTGTSSDLGGYNYVSWYQHRPGKAPKLIIYDVTVRPSGVSDRFSGSKSGNTASLTISGLQAEDEADYYCGSYTSSSTLLWVFGGGTKLTVL

SEQ ID NO: 229 - protein, 246 aa, Artificial Sequence
  source: /note="Description of Artificial Sequence: Synthetic scFv sequence"
EVQLVESGGGLVQPGRSLRLSCAASGFTFDDYAMHWVRQAPGKGLEWVSGISWNSGRIGYADSVKGRFTISRDNAKNSLFLQMNSLRAEDTAVYYCARDQGYHYYDSAEHAFDIWGQGTVVTVSSGGGGSGGGGSGGGGSQSALTQPRSVSGFPGQSVTISCTGTTSDDVSWYQQHPGKAPQLMLYDVSKRPSGVPHRFSGSRSGRAASLIISGLQTEDEADYFCCSYAGRYNSVLFGGGTKLTVL

SEQ ID NO: 230 - protein, 246 aa, Artificial Sequence
  source: /note="Description of Artificial Sequence: Synthetic scFv sequence"
EVQLVESGGGLVQPGRSLRLSCAASGFTFDDYAMHWVRQAPGKGLEWVSGISWNSGRIGYADSVKGRFTISRDNAKNSLFLQMNSLRAEDTAVYYCARDQGYHYYDSAEHAFDIWGQGTVVTVSSGGGGSGGGGSGGGGSQSALTQPRSVSGFPGQSVTISCTGTTSDDVSWYQQHPGKAPQLMLYDVSKRPSGVPHRFSGSRSGRAASLIISGLQTEDEADYFCCSYAGRYNSVPFGGGTKLTVL

SEQ ID NO: 231 - protein, 246 aa, Artificial Sequence
  source: /note="Description of Artificial Sequence: Synthetic scFv sequence"
EVQLVESGGGLVQPGRSLRLSCAASGFTFDDYAMHWVRQAPGKGLEWVSGISWNSGRIGYADSVKGRFTISRDNAKNSLFLQMNSLRAEDTAVYYCARDQGYHYYDSAEHAFDIWGQGTVVTVSSGGGGSGGGGSGGGGSQSALTQPRSVSGFPGQSVTISCTGTTSDDVSWYQQHPGKAPQLMLYDVSKRPSGVPHRFSGSRSGRAASLIISGLQTEDEADYFCSSYAGRYNSVLFGGGTKLTVL

SEQ ID NO: 232 - protein, 249 aa, Artificial Sequence
  source: /note="Description of Artificial Sequence: Synthetic scFv sequence"
EVQLVESGGGLVQPGRSLRLSCAASGFTFDDYAMHWVRQAPGKGLEWVSGISWNSGRIGYADSVKGRFTISRDNAKNSLFLQMNSLRAEDTAVYYCARDQGYHYYDSAEHAFDIWGQGTVVTVSSGGGGSGGGGSGGGGSQSVLTQPPSVSAAPGQEVTISCSGSSSNIGNNYVSWYQQLPGTAPKLLIYDNDKRPSGIPDRFSGSKSGTSATLGITGLQTGDEADYYCGTWDGNLSAVFGGGTKVTVL

SEQ ID NO: 233 - protein, 251 aa, Artificial Sequence
  source: /note="Description of Artificial Sequence: Synthetic scFv sequence"
EVQLVESGGGLVQPGRSLRLSCAASGFTFDDYAMHWVRQAPGKGLEWVSGISWNSGRIGYADSVKGRFTISRDNAKNSLFLQMNSLRAEDTAVYYCARDQGYHYYDSAEHAFDIWGQGTVVTVSSGGGGSGGGGSGGGGSQSVLTQPPSVSAAPGQKVTISCSGSSSNIGNNYVSWYQQLPGTAPKLLIYDNNKRPSGIPDRFSGSKSGTSATLGITGLQTGDEADYYCGTWDSSLNRDWVFGGGTKLTVL

SEQ ID NO: 234 - protein, 250 aa, Artificial Sequence
  source: /note="Description of Artificial Sequence: Synthetic scFv sequence"
EVQLVESGGGLVQPGRSLRLSCAASGFTFDDYAMHWVRQAPGKGLEWVSGISWNSGRIGYADSVKGRFTISRDNAKNSLFLQMNSLRAEDTAVYYCARDQGYHYYDSAEHAFDIWGQGTVVTVSSGGGGSGGGGSGGGGSQSVLTQPPSVSAAPGQKVTISCSGSSSNIGNNYVSWYQQLPGTAPKLLIYDNNKRPSGIPDRFSGSKSGTSATLGITGLQTGDEGDYYCGTWDISLRFGVFGGGTKVTVL

SEQ ID NO: 235 - protein, 249 aa, Artificial Sequence
  source: /note="Description of Artificial Sequence: Synthetic scFv sequence"
EVQLVQSGGGLVQPGRSLRLSCAASGFTFDDYAMHWVRQAPGKGLEWVSGISWNSGSIGYADSVKGRFTISRDNAKNSLYLQMNSLRAEDTAVYYCARDQGYHYYDSAEHAFDIWGQGTVVTVSSGGGGSGGGGSGGGGSAIRMTQSPSSLSASVGDRVTVTCQASQDISNYLNWYQQKPGRAPKLLIYDASNVKAGVPSRFSGGGSGTDFTLTISSLQPEDFATYYCQQSYSTPQAYTFGQGTKLDIK

SEQ ID NO: 236 - protein, 247 aa, Artificial Sequence
  source: /note="Description of Artificial Sequence: Synthetic scFv sequence"
EVQLVQSGGGLVQPGRSLRLSCAASGFTFDDYAMHWVRQAPGKGLEWVSGISWNSGSIGYADSVKGRFTISRDNAKNSLYLQMNSLRAEDTAVYYCARDQGYHYYDSAEHAFDIWGQGTVVTVSSGGGGSGGGGSGGGGSDIQLTQSPSTLSASVGDRVTITCRASQSISRWLAWYQQKPGKAPKLLIYDASNLETGVPSRFSGSGSGTDFTFTISSLQPEDIATYYCQQYDNLPLTFGGGTKVEIK

SEQ ID NO: 237 - protein, 249 aa, Artificial Sequence
  source: /note="Description of Artificial Sequence: Synthetic scFv sequence"
EVQLVQSGGGLVQPGRSLRLSCAASGFTFDDYAMHWVRQAPGKGLEWVSGISWNSGSIGYADSVKGRFTISRDNAKNSLYLQMNSLRAEDTAVYYCARDQGYHYYDSAEHAFDIWGQGTVVTVSSGGGGSGGGGSGGGGSEIVLTQSPATLSLSPGETATLSCRASQSINHYLAWYQQKPGQAPRLLIYDASNRATGIPARFSGSGSGTDFTLTISSLEPEDFATYYCQQSYSHPRMYTFGQGTKLDIK

SEQ ID NO: 238 - protein, 270 aa, Artificial Sequence
  source: /note="Description of Artificial Sequence: Synthetic scFv sequence"
MALPVTALLLPLALLLHAARPEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSGGGGSGGGGSGGGGSDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITRSDPTSS

SEQ ID NO: 239 - protein, 267 aa, Artificial Sequence
  source: /note="Description of Artificial Sequence: Synthetic scFv sequence"
MALPVTALLLPLALLLHAARPEVQLQQSGPDLVKPGASVKISCKASGYSFTGYYMHWVKQSHGKSLEWIGRINPNNGVTLYNQKFKDKAILTVDKSSTTAYMELRSLTSEDSAVYYCARSTMITNYVMDYWGQVTSVTVSSGGGGSGGGGSGGGGSSIVMTQTPTFLLVSAGDRVTITCKASQSVSNDVAWYQQKPGQSPTLLISYTSSRYAGVPDRFIGSGYGTDFTFTISTLQAEDLAVYFCQQDYNSPPTFGGGTKLEIKRSDP

SEQ ID NO: 240 - protein, 272 aa, Artificial Sequence
  source: /note="Description of Artificial Sequence: Synthetic scFv sequence"
MALPVTALLLPLALLLHAARPEVQLQQSGPELIKPGASVKMSCKASGYTFTSYVMHWVKQKPGQGLEWIGYINPYNDGTKYNEKFKGKATLTSDKSSSTAYMELSSLTSEDSAVYYCARGTYYYGSRVFDYWGQGTTLTVSSGGGGSGGGGSGGGGSDIVMTQAAPSIPVTPGESVSISCRSSKSLLNSNGNTYLYWFLQRPGQSPQLLIYRMSNLASGVPDRFSGSGSGTAFTLRISRVEAEDVGVYYCMQHLEYPFTFGAGTKLELKRSD

SEQ ID NO: 241 - protein, 273 aa, Artificial Sequence
  source: /note="Description of Artificial Sequence: Synthetic scFv sequence"
MALPVTALLLPLALLLHAARPEVQLQQSGPELIKPGASVKMSCKASGYTFTSYVMHWVKQKPGQGLEWIGYINPYNDGTKYNEKFKGKATLTSDKSSSTAYMELSSLTSEDSAVYYCARGTYYYGSRVFDYWGQGTTLTVSSGGGGSGGGGSGGGGSDIVMTQAAPSIPVTPGESVSISCRSSKSLLNSNGNTYLYWFLQRPGQSPQLLIYRMSNLASGVPDRFSGSGSGTAFTLRISRVEAEDVGVYYCMQHLEYPFTFGAGTKLELKRSDP

SEQ ID NO: 242 - protein, 277 aa, Artificial Sequence
  source: /note="Description of Artificial Sequence: Synthetic scFv sequence"
MAPAMESPTLLCVALLFFAPDGVLAEVQLQQSGPELIKPGASVKMSCKASGYTFTSYVMHWVKQKPGQGLEWIGYINPYNDGTKYNEKFKGKATLTSDKSSSTAYMELSSLTSEDSAVYYCARGTYYVGSRVFDYWGQGTTLTVSSGGGGSGGGGSGGGGSDIVMTQAAPSIPVTPGESVSISCRSSKSLLNSNGNTYLYWFLQRPGQSPQLLIYRMSNLASGVPDRFSGSGSGTAFTLRISRVEAEDVGVYVCMQHLEYPFTFGAGTKLELKRSDP

SEQ ID NO: 243 - protein, 277 aa, Artificial Sequence
  source: /note="Description of Artificial Sequence: Synthetic scFv sequence"
MAPAMESPTLLCVALLFFAPDGVLAEVQLQQSGPELIKPGASVKMSCKASGYTFTSYVMHWVKQKPGQGLEWIGYINPYNDGTKYNEKFKGKATLTSDKSSSTAYMELSSLTSEDSAVYYCARGTYYYGSRVFDYWGQGTTLTVSSGGGGSGGGGSGGGGSDIVMTQAAPSIPVTPGESVSISCRSSKSLLNSNGNTYLYWFLQRPGQSPQLLIYRMSNLASGVPDRFSGSGSGTAFTLRISRVEAEDVGVYYCMQHLEYPFTFGAGTKLELKRSDP

SEQ ID NO: 244 - protein, 495 aa, Artificial Sequence
  source: /note="Description of Artificial Sequence: Synthetic scFv sequence"
METDTLLLWVLLLWVPGSTGEVQLQQSGPELIKPGASVKMSCKASGYTFTSYVMHWVKQKPGQGLEWIGYINPYNDGTKYNEKFKGKATLTSDKSSSTAYMELSSLTSEDSAVYYCARGTYYYGSRVFDYWGQGTTLTVSSGGGGSGGGGSGGGGSDIVMTQAAPSIPVTPGESVSISCRSSKSLLNSNGNTYLYWFLQRPGQSPQLLIYRMSNLASGVPDRFSGSGSGTAFTLRISRVEAEDVGVYYCMQHLEYPFTFGAGTKLELKRSDPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 245 - protein, 252 aa, Artificial Sequence
  source: /note="Description of Artificial Sequence: Synthetic scFv sequence"
QITLKESGPTLVKPTQTLTLTCTFSGFSLSTSGVGVGWIRQPPGKALEWLALIYWDDDKRYSPSLKSRLTITKDTSKNQVVLTMTNMDPVDTATYYCAHIDYGSGSYSPRTSYYYYMSVWGKGTTVTVSSGGGGSGGGGSGGGGSAIQLTQSPSFLSASVGDRVTITCRASQGISSYLNWYQQRAGKAPELLIYAASNLQSGVPSRFSGSGSGTDFTLTITSVQPEDFATYFCQQGDAFPLTFGPGTKVTIR

SEQ ID NO: 246 - protein, 249 aa, Artificial Sequence
  source: /note="Description of Artificial Sequence: Synthetic scFv sequence"
QMQLVQSGGGLVQPGRSLRLSCAASGFTFDDYAMHWVRQAPGKGLEWVSGISWNSGSIGYADSVKGRFTISRDNAKNSLYLQMNSLRAEDTAVYYCARDQGYHYYDSAEHAFDIWGQGTVVTVSSGGGGSGGGGSGGGGSAIRMTQSPSSLSASVGDRVTVTCQASQDISNYLNWYQQKPGRAPKLLIYDASNVKAGVPSRFSGGGSGTDFTLTISSLQPEDFATYYCQQSYSTPQAYTFGQGTKLEIK

SEQ ID NO: 247 - protein, 248 aa, Artificial Sequence
  source: /note="Description of Artificial Sequence: Synthetic scFv sequence"
QMQLVQSGGGLVQPGRSLRLSCAASGFTFDDYAMHWVRQAPGKGLEWVSGISWNSGSIGYADSVKGRFTISRDNAKNSLYLQMNSLRAEDTAVYYCARDQGYHYYDSAEHAFDIWGQGTVVTVSSGGGGSGGGGSGGGGSAIRMTQSPSTLSASVGDRVTITCRASQSISHYLAWYQQKPGKAPKLLIFDASRLASGVPSRFSGSGSGTDFTLTISSLQPEDFATYYCQQSYGAPMFTFGPGTRVDLK

SEQ ID NO: 248 - protein, 119 aa, Artificial Sequence
  source: /note="Description of Artificial Sequence: Synthetic scFv sequence"
QVQLLESGAELVRPGSSVKISCKASGYAFSSYWMNWVKQRPGQGLEWIGQIYPGDGDTNYNGKFKGQATLTADKSSSTAYMQLSGLTSEDSAVYSCARKTISSVVDFYFDYWGQGTTVT

SEQ ID NO: 249 - protein, 464 aa, Artificial Sequence
  source: /note="Description of Artificial Sequence: Synthetic scFv sequence"
QVQLLESGAELVRPGSSVKISCKASGYAFSSYWMNWVKQRPGQGLEWIGQIYPGDGDTNYNGKFKGQATLTADKSSSTAYMQLSGLTSEDSAVYSCARKTISSVVDFYFDYWGQGTTVTGGGSGGGSGGGSGGGSELVLTQSPKFMSTSVGDRVSVTCKASQNVGTNVAWYQQKPGQSPKPLIYSATYRNSGVPDRFTGSGSGTDFTLTITNVQSKDLADYFCQYNRYPYTSFFFTKLEIKRRSKIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 250 - protein, 242 aa, Artificial Sequence
  source: /note="Description of Artificial Sequence: Synthetic scFv sequence"
QVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIK

SEQ ID NO: 251 - protein, 247 aa, Artificial Sequence
  source: /note="Description of Artificial Sequence: Synthetic scFv sequence"
QVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSSGGGGSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIK

SEQ ID NO: 252 - protein, 242 aa, Artificial Sequence
  source: /note="Description of Artificial Sequence: Synthetic scFv sequence"
QVQLQESGPGLVKPSETLSLTCTVSGVSLPDYGVSWIRQPPGKGLEWIGVIWGSETTYYSSSLKSRVTISKDNSKNQVSLKLSSVTAADTAVYYCAKHYYYGGSYAMDYWGQGTLVTVSSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIK

SEQ ID NO: 253 - protein, 241 aa, Artificial Sequence
  source: /note="Description of Artificial Sequence: Synthetic scFv sequence"
QVQLQQSGPELVKPGASVKISCKASGYAFSSSWMNWVKQRPGKGLEWIGRIYPGDEDTNYSGKFKDKATLTADKSSTTAYMQLSSLTSEDSAVYFCARSLLYGDYLDYWGQGTTLTVSSGGGGSGGGGSGGGGSQIVLTQSPAIMSASPGEKVTMTCSASSSVSYMHWYQQKSGTSPKRWIYDTSKLASGVPDRFSGSGSGTSYFLTINNMEAEDAATYYCQQWNINPLTFGAGTKLELKR

SEQ ID NO: 254 - protein, 251 aa, Artificial Sequence
  source: /note="Description of Artificial Sequence: Synthetic scFv sequence"
QVQLVESGGGLVQPGRSLRLSCAASGFTFDDYAMHWVRQAPGKGLEWVSGISWNSGRIGYADSVKGRFTISRDNAKNSLFLQMNSLRAEDTAVYYCARDQGYHYYDSAEHAFDIWGQGTMVTVSSGGGGSGGGGSGGGGSQAVLTQPRSVSGSPGQSVTISCTGISSGVDSHRYVSWYQHHPGKAPKLMIYDFSKRPSGVPDRFSGSKSGNTASLTISGLQAEDEADYYCSSYAAISPNYVFGTGTKLTVL

SEQ ID NO: 255 - protein, 239 aa, Artificial Sequence
  source: /note="Description of Artificial Sequence: Synthetic scFv sequence"
QVQLVESGGGLVQPGRSLRLSCAASGFTFDDYAMHWVRQAPGKGLEWVSGISWNSGRIGYADSVKGRFTISRDNAKNSLFLQMNSLRAEDTAVYYCARDQGYHYYDSAEHAFDIWGQGTMVTVSSGGGGSGGGGSGGGGSSYVLTQPPSASGTPGQRVTISCSGSSSNIGSNTVNWYQQFPGTAPKLLIYSNNQRPSGVPDRFSGSKSGTSASLAISGLQSEDEAEYYCAAWDDSLNVV

SEQ ID NO: 256 - protein, 250 aa, Artificial Sequence
  source: /note="Description of Artificial Sequence: Synthetic scFv sequence"
QVQLVESGGGLVQPGRSLRLSCAASGFTFDDYAMHWVRQAPGKGLEWVSGISWNSGRIGYADSVKGRFTISRDNAKNSLFLQMNSLRAEDTAVYYCARDQGYHYYDSAEHAFDIWGQGTVVTVSSGGGGSGGGGSGGGGSQSALTQPASVSGSPGHSITISCTGTRSDVGGFDYVSWYQHNPGKAPKLIIYDVTKRPSGVSNRFSGAKSGITASLTISGLQAEDEADYYCTSYRPGPTFVFGTGTKLDIK

SEQ ID NO: 257 - protein, 250 aa, Artificial Sequence
  source: /note="Description of Artificial Sequence: Synthetic scFv sequence"
QVQLVESGGGLVQPGRSLRLSCAASGFTFDDYAMHWVRQAPGKGLEWVSGISWNSGRIGYADSVKGRFTISRDNAKNSLFLQMNSLRAEDTAVYYCARDQGYHYYDSAEHAFDIWGQGTVVTVSSGGGGSGGGGSGGGGSQSALTQPASVSGSPGHSITISCTGTRSDVGGFDYVSWYQHNPGKAPKLIIYDVTKRPSGVSNRFSGAKSGITASLTISGLQAEDEADYYCTSYRPGPTFVFGTGTKLTVL

SEQ ID NO: 258 - protein, 252 aa, Artificial Sequence
  source: /note="Description of Artificial Sequence: Synthetic scFv sequence"
QVQLVESGGGLVQPGRSLRLSCAASGFTFDDYAMHWVRQAPGKGLEWVSGISWNSGRIGYADSVKGRFTISRDNAKNSLFLQMNSLRAEDTAVYYCARDQGYHYYDSAEHAFDIWGQGTVVTVSSGGGGSGGGGSGGGGSQSALTQPASVSGSPGQSITISCTGTSSDLGGYNYVSWYQHRPGKAPKLIIYDVTVRPSGVSDRFSGSKSGNTASLTISGLQAEDEADYYCGSYTSSSTLLWVFGGGTKLDIK

SEQ ID NO: 259 - protein, 252 aa, Artificial Sequence
  source: /note="Description of Artificial Sequence: Synthetic scFv sequence"
QVQLVESGGGLVQPGRSLRLSCAASGFTFDDYAMHWVRQAPGKGLEWVSGISWNSGRIGYADSVKGRFTISRDNAKNSLFLQMNSLRAEDTAVYYCARDQGYHYYDSAEHAFDIWGQGTVVTVSSGGGGSGGGGSGGGGSQSALTQPASVSGSPGQSITISCTGTSSDLGGYNYVSWYQHRPGKAPKLIIYDVTVRPSGVSDRFSGSKSGNTASLTISGLQAEDEADYYCGSYTSSSTLLWVFGGGTKLTVL

SEQ ID NO: 260 - protein, 252 aa, Artificial Sequence
  source: /note="Description of Artificial Sequence: Synthetic scFv sequence"
  MOD_RES (76)..(76): Any amino acid
  MOD_RES (201)..(201): Any amino acid
QVQLVESGGGLVQPGRSLRLSCAASGFTFDDYAMHWVRQAPGKGLEWVSGISWNSGRIGYADSVKGRFTISRDNAXNSLFLQMNSLRAEDTAVYYCARDQGYHYYDSAEHAFDIWGQGTVVTVSSGGGGSGGGGSGGGGSQSALTQPASVSGSPGQSITISCTETSSDLGGYNYVSWYQHRPGKAPKLIIYDVTVRPSGVXDRFSGSKSGNTASLTISGLQAEDEADYYCGSYTSSSTLLWVFGGGTKLTVL

SEQ ID NO: 261 - protein, 249 aa, Artificial Sequence
  source: /note="Description of Artificial Sequence: Synthetic scFv sequence"
  MOD_RES (64)..(65): Any amino acid
  MOD_RES (68)..(69): Any amino acid
  MOD_RES (93)..(93): Any amino acid
  MOD_RES (98)..(98): Any amino acid
  MOD_RES (102)..(102): Any amino acid
  MOD_RES (104)..(104): Any amino acid
  MOD_RES (113)..(113): Any amino acid
  MOD_RES (145)..(146): Any amino acid
  MOD_RES (148)..(149): Any amino acid
  MOD_RES (233)..(233): Any amino acid
  MOD_RES (244)..(244): Any amino acid
QVQLVESGGGLVQPGRSLRLSCAASGFTFDDYAMHWVRQAPGKGLEWVSGISWNSGRIGYADSXXGRXXISRDNAKNSLFLQMNSLRAEDTAXYYCAXDQGXHXYDSAEHAFXIWGQGTVVTVSSGGGGSGGGGSGGGGSQSVLXXPXXASGSPGQSVTVSCTGTGRDIGAYDYVSWYQQHPGKAPKLLIYGVNKRPSGVPDRFSGSKSDNTASLTVSGLQVEDEADYYCSSXAGRKYVFGTGXKVTVL

SEQ ID NO: 262 - protein, 249 aa, Artificial Sequence
  source: /note="Description of Artificial Sequence: Synthetic scFv sequence"
QVQLVQSGGGVVQPGRSLRLSCAASGFTFDDYAMHWVRQAPGKGLEWVSGISWNSGSIGYADSVKGRFTISRDNAKNSLYLQMNSLRAEDTAVYYCARDQGYHYYDSAEHAFDIWGQGTVVTVSSGGGGSGGGGSGGGGSEIVLTQSPATLSLSPGETATLSCRASQSINHYLAWYQQKPGQAPRLLIYDASNRATGIPARFSGSGSGTDFTLTISSLEPEDFATYYCQQSYSHPRMYTFGQGTKLEIK

SEQ ID NO: 263 - protein, 263 aa, Artificial Sequence
  source: /note="Description of Artificial Sequence: Synthetic scFv sequence"
WSHPQFEKGGGGSGGGGSDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGSTSGSGKPGSGEGSTKGEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSS

SEQ ID NO: 264 - DNA, 882 bp, Artificial Sequence
  source: /note="Description of Artificial Sequence: Synthetic scFv sequence"
atgaaatacctattgcctacggcagccgctggattgttattactcgcagcaagcggcgcgcatgcctcctatgagctgacacagccaccctcggtgtcagtggccccaggaaagacggccacaattccctgtgggggaaacaacattgagagtaaaagtgtccactggtaccagcagcggccaggccaggcccctgtcttggtcatctatgatgataccgaccggccctcagggatccctgagcgattctctggctccaactctgggaacacggccaccctgaccatcagcggggtcgaagccggggatgaggccgactatttctgtcaggtgtgggatagtcatagtgatcatgaggtgttcggcggagggaccaagctcaccgtcctatccggagggtcgaccataacttcgtataatgtatactatacgaagttatcctcgagcggttccgaggtgcagctggtggagaccgggggaggcttggtacagcctggagggtccctgagactctcctgtgcagcctctggattcaccttcagtagttatgaaatgaactgggtccgccaggctccagggaaggggctggagtgggtttcatacattagtagtagtggcagtaccatatactacgcagactctgtgaagggccgattcaccatctccagagacaacgccaagaactcactgtatctgcaaatgaacagcctgagagctgaggacacggctgtttattactgtgcgagagagcatgagtgggaggcgggcgcttttgatatctggggccaagggacaatggtcaccgtctcttcagctagcggcaaaccaatcccaaacccactgctgggcctggatagtactcaccatcaccatcaccattga

SEQ ID NO: 265 - protein, 293 aa, Artificial Sequence
  source: /note="Description of Artificial Sequence: Synthetic scFv sequence"
MKYLLPTAAAGLLLLAASGAHASYELTQPPSVSVAPGKTATIPCGGNNIESKSVHWYQQRPGQAPVLVIYDDTDRPSGIPERFSGSNSGNTATLTISGVEAGDEADYFCQVWDSHSDHEVFGGGTKLTVLSGGSTITSYNVYYTKLSSSGSEVQLVETGGGLVQPGGSLRLSCAASGFTFSSYEMNWVRQAPGKGLEWVSYISSSGSTIYYADSVKGRFTISRDNAKNSLYLQMNSLRAEDTAVYYCAREHEWEAGAFDIWGQGTMVTVSSASGKPIPNPLLGLDSTHHHHHH

SEQ ID NO: 266 - protein, 275 aa, Artificial Sequence
  source: /note="Description of Artificial Sequence: Synthetic scFv sequence"
  MOD_RES (236)..(236): Any amino acid
  MOD_RES (245)..(245): Any amino acid
GAHASYELTQPPSVSVAPGKTATIPCGGNNIESKSVHWYQQRPGQAPVLVIYDDTDRPSGIPERFSGSNSGNTATLTISGVEAGDEADYFCQVWDSHSDHEVFGGGTKLTVLSGGSTITSYNVYYTKLSSSGSEVQLVETGGGLVQPGGSLRLSCAASGFTFSSYEMNWVRQAPGKGLEWVSYISSSGSTIYYADSVKGRFTISRDNAKNSLYLQMNSLRAEDTAVYYCAREHEWXAGAFDIWGXGTMVTVSSASGKPIPNPLLGLDSTHHHHHH

SEQ ID NO: 267 - protein, 273 aa, Artificial Sequence
  source: /note="Description of Artificial Sequence: Synthetic scFv sequence"
GAHAQPVLTQPPSVSVAPGQTAKITCGGNNIGSKSVHWYQQKPGQAPVLVVYDDSDRPSGIPERFSGSNSGNAATLTISRVEAGDEADYYCQVWDSSSGLVFGTGTKVTVLSGGSTITSYNVYDTKLSSSGTEVQLLESGAEVKKPGESLKISCKGSGYSFTSYWIGWVRQMPGKGLEWMGIIYPGDSDTRYSPSSQGQVTISADKSISTAYLRWSGLKASDTAMYYCARVSSDSGAFDIWGQGTMVTVSSASGKPIPNPLLGLDSTHHHHHH

SEQ ID NO: 268 - DNA, 822 bp, Artificial Sequence
  source: /note="Description of Artificial Sequence: Synthetic scFv sequence"
ggcgcgcatgcccagccagtgctgactcagcccccctcggtgtcagtggccccgggacagacggccaagatcacctgtgggggaaacaacattggaagtaaaagtgtgcactggtaccagcagaagccaggccaggcccctgtgctggtcgtctatgatgatagcgaccggccctcagggatccctgagcgattctctggctccaactctgggaacgcggccaccctgaccatcagcagggtcgaagccggggatgaggccgactattactgtcaggtgtgggatagtagtagtggccttgtcttcggaactgggaccaaggtcaccgtcctatccggagggtcgaccataacttcgtataatgtatacgatacgaagttatcctcgagcggtaccgaggtgcagttgttggagtctggagcagaggtgaaaaagccgggggagtctctgaagatctcctgtaagggttctggatacagctttaccagctactggatcggctgggtgcgccagatgcccgggaaaggcctggagtggatggggatcatctatcctggtgactctgataccagatacagcccgtcctcccaaggccaggtcaccatctcagccgacaagtccatcagcaccgcctacctgcggtggagcggcctgaaggcctcggacaccgccatgtattactgtgcgagagtatcgagtgactccggtgcttttgatatctggggccaagggacaatggtcaccgtctcttcagctagcggcaaaccaatcccaaacccactgctgggcctggatagtactcaccatcaccatcaccattag

SEQ ID NO: 269 - DNA, 813 bp, Artificial Sequence
  source: /note="Description of Artificial Sequence: Synthetic scFv sequence"
atggccctccctgtcaccgccctgctgcttccgctggctcttctgctccacgccgctcggcccgaaattgtgatgacccagtcacccgccactcttagcctttcacccggtgagcgcgcaaccctgtcttgcagagcctcccaagacatctcaaaataccttaattggtatcaacagaagcccggacaggctcctcgccttctgatctaccacaccagccggctccattctggaatccctgccaggttcagcggtagcggatctgggaccgactacaccctcactatcagctcactgcagccagaggacttcgctgtctatttctgtcagcaagggaacaccctgccctacacctttggacagggcaccaagctcgagattaaaggtggaggtggcagcggaggaggtgggtccggcggtggaggaagccaggtccaactccaagaaagcggaccgggtcttgtgaagccatcagaaactctttcactgacttgtactgtgagcggagtgtctctccccgattacggggtgtcttggatcagacagccaccggggaagggtctggaatggattggagtgatttggggctctgagactacttactactcttcatccctcaagtcacgcgtcaccatctcaaaggacaactctaagaatcaggtgtcactgaaactgtcatctgtgaccgcagccgacaccgccgtgtactattgcgctaagcattactattatggcgggagctacgcaatggattactggggacagggtactctggtcaccgtgtccagccaccaccatcatcaccatcaccat

SEQ ID NO: 270 - DNA, 813 bp, Artificial Sequence
  source: /note="Description of Artificial Sequence: Synthetic scFv sequence"
atggccctccctgtcaccgccctgctgcttccgctggctcttctgctccacgccgctcggcccgaaattgtgatgacccagtcacccgccactcttagcctttcacccggtgagcgcgcaaccctgtcttgcagagcctcccaagacatctcaaaataccttaattggtatcaacagaagcccggacaggctcctcgccttctgatctaccacaccagccggctccattctggaatccctgccaggttcagcggtagcggatctgggaccgactacaccctcactatcagctcactgcagccagaggacttcgctgtctatttctgtcagcaagggaacaccctgccctacacctttggacagggcaccaagctcgagattaaaggtggaggtggcagcggaggaggtgggtccggcggtggaggaagccaggtccaactccaagaaagcggaccgggtcttgtgaagccatcagaaactctttcactgacttgtactgtgagcggagtgtctctccccgattacggggtgtcttggatcagacagccaccggggaagggtctggaatggattggagtgatttggggctctgagactacttactaccaatcatccctcaagtcacgcgtcaccatctcaaaggacaactctaagaatcaggtgtcactgaaactgtcatctgtgaccgcagccgacaccgccgtgtactattgcgctaagcattactattatggcgggagctacgcaatggattactggggacagggtactctggtcaccgtgtccagccaccaccatcatcaccatcaccat

SEQ ID NO: 271 - protein, 271 aa, Artificial Sequence
  source: /note="Description of Artificial Sequence: Synthetic scFv sequence"
MALPVTALLLPLALLLHAARPEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSSHHHHHHHH

SEQ ID NO: 272 - DNA, 813 bp, Artificial Sequence
  source: /note="Description of Artificial Sequence: Synthetic scFv sequence"
atggctctgcccgtgaccgcactcctcctgccactggctctgctgcttcacgccgctcgcccacaagtccagcttcaagaatcagggcctggtctggtgaagccatctgagactctgtccctcacttgcaccgtgagcggagtgtccctcccagactacggagtgagctggattagacagcctcccggaaagggactggagtggatcggagtgatttggggtagcgaaaccacttactattcatcttccctgaagtcacgggtcaccatttcaaaggataactcaaagaatcaagtgagcctcaagctctcatcagtcaccgccgctgacaccgccgtgtattactgtgccaagcattactactatggagggtcctacgccatggactactggggccagggaactctggtcactgtgtcatctggtggaggaggtagcggaggaggcgggagcggtggaggtggctccgaaatcgtgatgacccagagccctgcaaccctgtccctttctcccggggaacgggctaccctttcttgtcgggcatcacaagatatctcaaaatacctcaattggtatcaacagaagccgggacaggcccctaggcttcttatctaccacacctctcgcctgcatagcgggattcccgcacgctttagcgggtctggaagcgggaccgactacactctgaccatctcatctctccagcccgaggacttcgccgtctacttctgccagcagggtaacaccctgccgtacaccttcggccagggcaccaagcttgagatcaaacatcaccaccatcatcaccatcac

SEQ ID NO: 273 - protein, 271 aa, Artificial Sequence
  source: /note="Description of Artificial Sequence: Synthetic scFv sequence"
MALPVTALLLPLALLLHAARPQVQLQESGPGLVKPSETLSLTCTVSGVSLPDYGVSWIRQPPGKGLEWIGVIWGSETTYYSSSLKSRVTISKDNSKNQVSLKLSSVTAADTAVYYCAKHYYYGGSYAMDYWGQGTLVTVSSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKHHHHHHHH

SEQ ID NO: 274 - DNA, 813 bp, Artificial Sequence
  source: /note="Description of Artificial Sequence: Synthetic scFv sequence"
atggctctgcccgtgaccgcactcctcctgccactggctctgctgcttcacgccgctcgcccacaagtccagcttcaagaatcagggcctggtctggtgaagccatctgagactctgtccctcacttgcaccgtgagcggagtgtccctcccagactacggagtgagctggattagacagcctcccggaaagggactggagtggatcggagtgatttggggtagcgaaaccacttactatcaatcttccctgaagtcacgggtcaccatttcaaaggataactcaaagaatcaagtgagcctcaagctctcatcagtcaccgccgctgacaccgccgtgtattactgtgccaagcattactactatggagggtcctacgccatggactactggggccagggaactctggtcactgtgtcatctggtggaggaggtagcggaggaggcgggagcggtggaggtggctccgaaatcgtgatgacccagagccctgcaaccctgtccctttctcccggggaacgggctaccctttcttgtcgggcatcacaagatatctcaaaatacctcaattggtatcaacagaagccgggacaggcccctaggcttcttatctaccacacctctcgcctgcatagcgggattcccgcacgctttagcgggtctggaagcgggaccgactacactctgaccatctcatctctccagcccgaggacttcgccgtctacttctgccagcagggtaacaccctgccgtacaccttcggccagggcaccaagcttgagatcaaacatcaccaccatcatcaccatcac

SEQ ID NO: 275 - protein, 271 aa, Artificial Sequence
  source: /note="Description of Artificial Sequence: Synthetic scFv sequence"
MALPVTALLLPLALLLHAARPQVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKHHHHHHHH

SEQ ID NO: 276 - DNA, 828 bp, Artificial Sequence
  source: /note="Description of Artificial Sequence: Synthetic scFv sequence"
atggccctcccagtgaccgctctgctgctgcctctcgcacttcttctccatgccgctcggcctgagatcgtcatgacccaaagccccgctaccctgtccctgtcacccggcgagagggcaaccctttcatgcagggccagccaggacatttctaagtacctcaactggtatcagcagaagccagggcaggctcctcgcctgctgatctaccacaccagccgcctccacagcggtatccccgccagattttccgggagcgggtctggaaccgactacaccctcaccatctcttctctgcagcccgaggatttcgccgtctatttctgccagcaggggaatactctgccgtacaccttcggtcaaggtaccaagctggaaatcaagggaggcggaggatcaggcggtggcggaagcggaggaggtggctccggaggaggaggttcccaagtgcagcttcaagaatcaggacccggacttgtgaagccatcagaaaccctctccctgacttgtaccgtgtccggtgtgagcctccccgactacggagtctcttggattcgccagcctccggggaagggtcttgaatggattggggtgatttggggatcagagactacttactactcttcatcacttaagtcacgggtcaccatcagcaaagataatagcaagaaccaagtgtcacttaagctgtcatctgtgaccgccgctgacaccgccgtgtactattgtgccaaacattactattacggagggtcttatgctatggactactggggacaggggaccctggtgactgtctctagccatcaccatcaccaccatcatcac

SEQ ID NO: 277 - protein, 276 aa, Artificial Sequence
  source: /note="Description of Artificial Sequence: Synthetic scFv sequence"
MALPVTALLLPLALLLHAARPEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSGGGGSQVQLQESGPGLVKPSETLSLTCTVSGVSLPDYGVSWIRQPPGKGLEWIGVIWGSETTYYSSSLKSRVTISKDNSKNQVSLKLSSVTAADTAVYYCAKHYYYGGSYAMDYWGQGTLVTVSSHHHHHHHH

SEQ ID NO: 278 - protein, 248 aa, Artificial Sequence
  source: /note="Description of Artificial Sequence: Synthetic scFv sequence"
QVQLLESGAELVRPGSSVKISCKASGYAFSSYWMNWVKQRPGQGLEWIGQIYPGDGDTNYNGKFKGQATLTADKSSSTAYMQLSGLTSEDSAVYSCARKTISSVVDFYFDYWGQGTTVTGSTSGSGKPGSGEGSTKGELVLTQSPKFMSTSVGDRVSVTCKASQNVGTNVAWYQQKPGQSPKPLIYSATYRNSGVPDRFTGSGSGTDFTLTITNVQSKDLADYFYFCQYNRYPYTSGGGTKLEIKRRS

SEQ ID NO: 279 - protein, 514 aa, Artificial Sequence
  source: /note="Description of Artificial Sequence: Synthetic scFv sequence"
EIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSSGGGGSGGGGSGGGGSGGGGSEVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCARDLGWIAVAGTFDYWGQGTLVTVSSGGGGSGGGGSGGGGSQSALTQPASVSGSPGQSITISCTGTSSDVGGYNYVSWYQQHPGKAPKLMIYDVSKRPSGVSNRFSGSKSGNTASLTISGLQAEDEADYYCSSYTSSSLNHVFGTGTKVTVLT

SEQ ID NO: 280 - protein, 514 aa, Artificial Sequence
  source: /note="Description of Artificial Sequence: Synthetic scFv sequence"
EVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCARDLGWIAVAGTFDYWGQGTLVTVSSGGGGSGGGGSGGGGSQSALTQPASVSGSPGQSITISCTGTSSDVGGYNYVSWYQQHPGKAPKLMIYDVSKRPSGVSNRFSGSKSGNTASLTISGLQAEDEADYYCSSYTSSSLNHVFGTGTKVTVLTGGGGSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSS

SEQ ID NO: 281 - protein, 271 aa, Artificial Sequence
  source: /note="Description of Artificial Sequence: Synthetic scFv sequence"
MALPVTALLLPLALLLHAARPEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYSSSLKSRVTISKDNSKNQVSLKLSSVTAADTAVYYCAKHYYYGGSYAMDYWGQGTLVTVSSHHHHHHHH

SEQ ID NO: 282 - protein, 242 aa, Artificial Sequence
  source: /note="Description of Artificial Sequence: Synthetic scFv sequence"
EIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYSSSLKSRVTISKDNSKNQVSLKLSSVTAADTAVYYCAKHYYYGGSYAMDYWGQGTLVTVSS

SEQ ID NO: 283 - protein, 247 aa, Artificial Sequence
  source: /note="Description of Artificial Sequence: Synthetic scFv sequence"
QVQLQESGPGLVKPSETLSLTCTVSGVSLPDYGVSWIRQPPGKGLEWIGVIWGSETTYYNSSLKSRVTISKDNSKNQVSLKLSSVTAADTAVYYCAKHYYYGGSYAMDYWGQGTLVTVSSGGGGSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIK

SEQ ID NO: 284 - protein, 242 aa, Artificial Sequence
  source: /note="Description of Artificial Sequence: Synthetic scFv sequence"
EIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYNSSLKSRVTISKDNSKNQVSLKLSSVTAADTAVYYCAKHYYYGGSYAMDYWGQGTLVTVSS

SEQ ID NO: 285 - protein, 242 aa, Artificial Sequence
  source: /note="Description of Artificial Sequence: Synthetic scFv sequence"
QVQLQESGPGLVKPSETLSLTCTVSGVSLPDYGVSWIRQPPGKGLEWIGVIWGSETTYYNSSLKSRVTISKDNSKNQVSLKLSSVTAADTAVYYCAKHYYYGGSYAMDYWGQGTLVTVSSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIK

SEQ ID NO: 286 - protein, 242 aa, Artificial Sequence
  source: /note="Description of Artificial Sequence: Synthetic scFv sequence"
EIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSS

SEQ ID NO: 287 - protein, 247 aa, Artificial Sequence
  source: /note="Description of Artificial Sequence: Synthetic scFv sequence"
QVQLQESGPGLVKPSETLSLTCTVSGVSLPDYGVSWIRQPPGKGLEWIGVIWGSETTYYSSSLKSRVTISKDNSKNQVSLKLSSVTAADTAVYYCAKHYYYGGSYAMDYWGQGTLVTVSSGGGGSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIK

SEQ ID NO: 288 - protein, 247 aa, Artificial Sequence
  source: /note="Description of Artificial Sequence: Synthetic scFv sequence"
EIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSGGGGSQVQLQESGPGLVKPSETLSLTCTVSGVSLPDYGVSWIRQPPGKGLEWIGVIWGSETTYYNSSLKSRVTISKDNSKNQVSLKLSSVTAADTAVYYCAKHYYYGGSYAMDYWGQGTLVTVSS

SEQ ID NO: 289 - protein, 111 aa, Artificial Sequence
  source: /note="Description of Artificial Sequence: Synthetic scFv sequence"
ELVLTQSPKFMSTSVGDRVSVTCKASQNVGTNVAWYQQKPGQSPKPLIYSATYRNSGVPDRFTGSGSGTDFTLTITNVQSKDLADYFYFCQYNRYPYTSGGGTKLEIKRRS

SEQ ID NO: 290 - protein, 251 aa, Artificial Sequence
  source: /note="Description of Artificial Sequence: Synthetic scFv sequence"
EVQLVQSGAEVKKPGESLKISCKGSGFTFRDYYMAWVRQMPGKGLEWMGSISYEGNPYYGDSVKGQVTISRDNSISTLYLQWSSLKASDTAMYYCARHDHNNVDWFAYWGQGTLVTVSSGGGGSGGGGSGGGGSGGGGSDIQMTQSPSSLSASVGDRVTITCKSSQSLLYSENKKNYLAWYQQKPGKVPKLLIFWASTRESGVPSRFSGSGSGTDFTLTISSLQPEDVATYYCQQYYNFPTFGQGTKLEIK

SEQ ID NO: 291 - protein, 251 aa, Artificial Sequence
  source: /note="Description of Artificial Sequence: Synthetic scFv sequence"
EVQLVQSGAEVKKPGESLKISCKGSGFTFRDYYMAWVRQMPGKGLEWMGSISYEGNPYYGDSVKGQVTISRDNSISTLYLQWSSLKASDTAMYYCARHDHNNVDWFAYWGQGTLVTVSSGGGGSGGGGSGGGGSGGGGSEIVMTQSPATLSLSPGERATLSCKSSQSLLYSENKKNYLAWYQQKPGQAPRLLIFWASTRESGIPARFSGSGSGTDFTLTISSLQPEDLAVYYCQQYYNFPTFGQGTKLEIK

SEQ ID NO: 292 - protein, 251 aa, Artificial Sequence
  source: /note="Description of Artificial Sequence: Synthetic scFv sequence"
QVQLVESGGGVVQPGRSLRLSCAASGFTFRDYYMAWVRQAPGKGLEWVASISYEGNPYYGDSVKGRFTISRDNAKSTLYLQMSSLRAEDTAVYYCARHDHNNVDWFAYWGQGTLVTVSSGGGGSGGGGSGGGGSGGGGSDIVMTQTPLSLSVTPGQPVSMSCKSSQSLLYSENKKNYLAWYLQKPGQSPQLLIFWASTRESGVPDRFSGSGSGTDFTLKISRVEAEDVGVYYCQQYYNFPTFGQGTKLEIK

SEQ ID NO: 293 - protein, 251 aa, Artificial Sequence
  source: /note="Description of Artificial Sequence: Synthetic scFv sequence"
QVQLVQSGAEVKKPGASVKVSCKASGFTFRDYYMAWVRQAPGQGLEWMGSISYEGNPYYGDSVKGRVTMTRDNSTSTLYMELSSLRSEDTAVYYCARHDHNNVDWFAYWGQGTLVTVSSGGGGSGGGGSGGGGSGGGGSDIQMTQSPSSLSASVGDRVTITCKSSQSLLYSENKKNYLAWYQQKPGKVPKLLIFWASTRESGVPSRFSGSGSGTDFTLTISSLQPEDVATYYCQQYYNFPTFGQGTKLEIK

SEQ ID NO: 294 - protein, 251 aa, Artificial Sequence
  source: /note="Description of Artificial Sequence: Synthetic scFv sequence"
QVQLVQSGAEVKKPGASVKVSCKASGFTFRDYYMAWVRQAPGQGLEWMGSISYEGNPYYGDSVKGRVTMTRDNSTSTLYMELSSLRSEDTAVYYCARHDHNNVDWFAYWGQGTLVTVSSGGGGSGGGGSGGGGSGGGGSEIVMTQSPATLSLSPGERATLSCKSSQSLLYSENKKNYLAWYQQKPGQAPRLLIFWASTRESGIPARFSGSGSGTDFTLTISSLQPEDLAVYYCQQYYNFPTFGQGTKLEIK

SEQ ID NO: 295 - protein, 251 aa, Artificial Sequence
  source: /note="Description of Artificial Sequence: Synthetic scFv sequence"
QVQLVQSGAEVKKPGASVKVSCKASGFTFRDYYMAWVRQAPGQRLEWMGSISYEGNPYYGDSVKGRVTITRDNSASTLYMELSSLRSEDTAVYYCARHDHNNVDWFAYWGQGTLVTVSSGGGGSGGGGSGGGGSGGGGSDIQMTQSPSSLSASVGDRVTITCKSSQSLLYSENKKNYLAWYQQKPGKVPKLLIFWASTRESGVPSRFSGSGSGTDFTLTISSLQPEDVATYYCQQYYNFPTFGQGTKLEIK

SEQ ID NO: 296 - protein, 247 aa, Artificial Sequence
  source: /note="Description of Artificial Sequence: Synthetic scFv sequence"
EVQLQQSGPGLVKPSLTLSLTCAISGDSVSSNSATWTWIRQSPSRGLEWLGRTYYRSTWYNDYAVSVKSRITINPDTSKNQFSLQLNSVTPEDTAVYYCAREGSGSYYAYWGQGTLVTVSSGGGGSGGGGSGGGGSQSALTQPASVSGSPGQSITISCTGTSSDVGGYNYVSWYQQHPGKAPKLMIYDVSNRPSGVSNRFSGSKSGNTASLTISGLQAEDEADYYCSSYTSSSTLYVFGTGTKVTVL

SEQ ID NO: 297 - protein, 253 aa, Artificial Sequence
  source: /note="Description of Artificial Sequence: Synthetic scFv sequence"
EVQLQQSGPGLVKPSQTLPLTCAISGDSVLSNSDTWNWIRQSPSRGLEWLGRTYHRSTWYDDYASSVRGRVSINVDTSKNQYSLQLNAVTPEDTGVYYCARVRLQDGNSWSDAFDVWGQGTMVTVSSGGGGSGGGGSGGGGPQSALTQPASASGSPGQSVTISCTGTSSDVGGYNYVSWYQQHPGKAPKLMIYDVSNRPSGVSNRFSGSKSGNTASLTISGLQAEDEADYYCSSYTSSSTLYVFGTGTQLTVL

SEQ ID NO: 298 - protein, 253 aa, Artificial Sequence
  source: /note="Description of Artificial Sequence: Synthetic scFv sequence"
EVQLQQSGPGLVKPSQTLSLTCAISGDSMLSNSDTWNWIRQSPSRGLEWLGRTYHRSTWYDDYASSVRGRVSINVDTSKNQYSLQLNAVTPEDTGVYYCARVRLQDGNSWSDAFDVWGQGTMVTVSSGGGGSGGGGSGGGGSQSALTQPASASGSPGQSVTISCTGTSSDVGGYNYVSWYQQHPGKAPKLMIYDVSNRPSGVSNRFSGSKSGNTASLTISGLQAEDEADYYCSSYTSSSTLYVFGTGTQLTVL

SEQ ID NO: 299 - protein, 253 aa, Artificial Sequence
  source: /note="Description of Artificial Sequence: Synthetic scFv sequence"
EVQLQQSGPGLVKPSQTLSLTCAISGDSVLSNSDTWNWIRQSPSRGLEWLGRTYHRSTWYDDYASSVRGRVSINVDTSKNQYSLQLNAVTPEDTGAYYCARDRLQDGNSWSDAFDVWGQGTMVTVSSGGGGSGGGGSGGGGSQSALTQPASVSGSPGQSITISCTGTSSDVGGYNYVSWYQQHPGKAPKLMIYDVSNRPSGVSNRFSGSKSGNTASLTISGLQAEDEADYYCSSYTSSSTPYVFGTGTQLTVL

SEQ ID NO: 300 - protein, 253 aa, Artificial Sequence
  source: /note="Description of Artificial Sequence: Synthetic scFv sequence"
EVQLQQSGPGLVKPSQTLSLTCAISGDSVLSNSDTWNWIRQSPSRGLEWLGRTYHRSTWYDDYASSVRGRVSINVDTSKNQYSLQLNAVTPEDTGVYYCARDRLQDGNSWSDAFDVWGQGTMVTVSSGGGGSGGGGSGGGGSQSALTQPASASGSPGQSVTISCTGTSSDVGGYNYVSWYQQHPGKAPKLMIYDVSNRPSGVSNRFSGSKSGNTASLTISGLQAEDEADYYCSSYTSSSTLYVFGTGTQLTVL

SEQ ID NO: 301 - protein, 254 aa, Artificial Sequence
  source: /note="Description of Artificial Sequence: Synthetic scFv sequence"
EVQLQQSGPGLVKPSQTLSLTCAISGDSVLSNSDTWNWIRQSPSRGLEWLGRTYHRSTWYDDYASSVRGRVSINVDTSKNQYSLQLNAVTPEDTGVYYCARDRLQDGNSWSDAFDVWGQGTMVTVSSGGGGSGGGGSGGGGSQSALTQPASVSGSPGQSITISCTGSSSDIGGFNYVSWYQQHAGEAPKLMIYEVTNRPSGVSDRFSGSKSDNTASLTISGLQAEDEADYYCSSYASGSPLYVFGTGTKVTVLG

SEQ ID NO: 302 - protein, 254 aa, Artificial Sequence
  source: /note="Description of Artificial Sequence: Synthetic scFv sequence"
EVQLQQSGPGLVKPSQTLSLTCAISGDSVLSNSDTWNWIRQSPSRGLEWLGRTYHRSTWYDDYASSVRGRVSINVDTSKNQYSLQLNAVTPEDTGVYYCARDRLQDGNSWSDAFDVWGQGTMVTVSSGGGGSGGGGSGGGGSQSALTQPASVSGSPGQSITISCTGTSSDVGGYNYVSWYQQHPGKAPKLMIYDVSNRPSGVSNRFSGSKSGNTASLTISGLQAEDEADYYCSSYTSSSTLVYVFGTGTKVTVL

SEQ ID NO: 303 - protein, 254 aa, Artificial Sequence
  source: /note="Description of Artificial Sequence: Synthetic scFv sequence"
EVQLQQSGPGLVKPSQTLSLTCAISGDSVLSNSDTWNWIRQSPSRGLEWLGRTYHRSTWYDDYASSVRGRVSINVDTSKNQYSLQLNAVTPEDTGVYYCARDRLQDGNSWSDAFDVWGQGTMVTVSSGGGGSGGGGSGGGGSQSALTQPASVSGSPGQSITISCTGTSSDVGGYNYVSWYQQHPGKAPKLMIYDVSNRPSGVSNRFSGSKSGNTASLTISGLQAEDEADYYCSSYTSSSTLYVFGTGTKVTVLG

SEQ ID NO: 304 - protein, 254 aa, Artificial Sequence
  source: /note="Description of Artificial Sequence: Synthetic scFv sequence"
EVQLQQSGPGLVKPSQTLSLTCAISGDSVLSNSDTWNWIRQSPSRGLEWLGRTYHRSTWYDDYASSVRGRVSINVDTSKNQYSLQLNAVTPEDTGVYYCARDRLQDGNSWSDAFDVWGQGTMVTVSSGGGGSGGGGSGGGGSQSALTQPASVSGSPGQSITISCTGTSSDVGGYNYVSWYQQHPGKAPKLMIYEVSNRPSGVSNRFSGSKSGNTASLTISGLQAEDEADYYCSSYTSSSTLYIFGTGTKVTVLG

SEQ ID NO: 305 - protein, 254 aa, Artificial Sequence
  source: /note="Description of Artificial Sequence: Synthetic scFv sequence"
EVQLQQSGPGLVKPSQTLSLTCAISGDSVLSNSDTWNWIRQSPSRGLEWLGRTYHRSTWYDDYASSVRGRVSINVDTSKNQYSLQLNAVTPEDTGVYYCARDRLQDGNSWSDAFDVWGQGTMVTVSSGGGGSGGGGSGSGGSQSALTQPASVSGSPGQSITFSCTGTSSDIGGYNYVSWYQQHPGKAPKLMIYEVSNRPSGVSNRFSGTKSGNTASLTISGLQAEDEADYYCSSYTSSSTLYVFGTGTKLTVLG

SEQ ID NO: 306 - protein, 251 aa, Artificial Sequence
  source: /note="Description of Artificial Sequence: Synthetic scFv sequence"
EVQLQQSGPGLVKPSQTLSLTCAISGDSVSNNNAAWNWIRQSPSRGLEWLGRTYHRSTWYNDYVGSVKSRITINPDTSKNQFSLQLNSVTPEDTAVYYCARETDYGDYGAFDIWGQGTTVTVSSGGGGSGGGGSGGGGSQSALTQPASVSGSPGQSITISCTGSRNDIGAYESVSWYQQHPGNAPKLIIHGVNNRPSGVFDRFSVSQSGNTASLTISGLQAEDEADYYCSSHTTTSTLYVFGTGTKVTVLG

SEQ ID NO: 307 - protein, 251 aa, Artificial Sequence
  source: /note="Description of Artificial Sequence: Synthetic scFv sequence"
EVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCARDLGWIAVAGTFDYWGQGTLVTVSSGGGGSGGGGSGGGGSQSALTQPASVSGSPGQSITISCTGTSSDVGGYNYVSWYQQHPGKAPKLMIYDVSKRPSGVSNRFSGSKSGNTASLTISGLQAEDEADYYCSSYTSSSLNHVFGTGTKVTVL

SEQ ID NO: 308 - protein, 249 aa, Artificial Sequence
  source: /note="Description of Artificial Sequence: Synthetic scFv sequence"
EVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCAREESSSGWYEGNWFDPWGQGTLVTVSSGGGGSGGGGSGGGGSSSELTQDPAVSVALGQTVRITCQGDSLRSYYASWYQQKPGQAPVLVIYGKNHRPSGIPDRFSGSSSGDTDSLTITGAQAEDEADYYCHSRDSSGNHLFGGGTKLTVL

SEQ ID NO: 309 - protein, 254 aa, Artificial Sequence
  source: /note="Description of Artificial Sequence: Synthetic scFv sequence"
EVQLQQSGPGLVKPSQTLSLTCAISGDSVSSNSAAWNWIRQSPSRGLEWLGRTYYRSKWYSDYAVSVKSRITINPDTSKNQFSLQLNSVTPEDTAVYYCARDPYDFWSGYPDAFDIWGQGTMVTVSSGGGGSGGGGSGGGGSQSALTQPASVSGSPGQSITISCTGTSSDVGGYNYVSWYQQHPGKAPKVIISEVNNRPSGVSHRFSGSKSGNTASLTISGLQAEDEADYFCSSYTSGRTLYVFGTGSKVTVLG

SEQ ID NO: 310 - protein, 247 aa, Artificial Sequence
  source: /note="Description of Artificial Sequence: Synthetic scFv sequence"
EVQLQQSGPGLVNPSQTLSITCAISGDSVSSNSAAWNWIRQSPSRGLEWLGRTFYRSKWYNDYAVSVKGRITISPDTSKNQFSLQLNSVTPEDTAVYYCAGGDYYYGLDVWGQGTTVTVSSGGGGSGGGGSGGGGSQSALTQPASVSGSPGQSITISCTGSSSDVGGYNSVSWYQQHPGKAPKLMIYEVINRPSGVSHRFSGSKSGNTASLTISGLQAEDEADYYCSSYTSSSTYVFGTGTKVTVLG

SEQ ID NO: 311 - protein, 252 aa, Artificial Sequence
  source: /note="Description of Artificial Sequence: Synthetic scFv sequence"
EVQLVESGAEVKKPGASVKVSCKASGYTFTGYYMHWVRQAPGQGLEWMGWINPNSGGTNYAQKFQGRVTMTRDTSISTAYMELSRLRSDDTAVYYCAREPASSSWYGYYYYMDVWGKGTLVTVSSGGGGSGGGGSGGGGSGGGGSDIQMTQSPSSLSASVGDRVTITCRASQSINTYLNWYQQKPGKPPKLLIYAASNLQSGVPSRFSGSGSGTHFTLTISSLQPDDFATYYCQQSYSSLLTFGGGTKLEIK

SEQ ID NO: 312 - protein, 243 aa, Artificial Sequence
  source: /note="Description of Artificial Sequence: Synthetic scFv sequence"
EVQLVESGAEVKKPGASVKVSCKASGYTFTSYYMHWVRQAPGQGLEWMGIINPSGGSTSYAQKFQGRVTMTRDTSTSTAYMELSSLRSEDTAVYYCAREAGVVAVDYWGQGTLVTVSSGGGGSGGGGSGGGGSQSALTQPASVSGSPGQSITISCTGTSSDVGGYNYVSWYQQHPGKAPKLMIYDVSNRPSGVSNRFSGSKSGNTASLTISGLQAEDEADYYCSSYTSSSTWVFGGGTKLTVL

SEQ ID NO: 313 - protein, 247 aa, Artificial Sequence
  source: /note="Description of Artificial Sequence: Synthetic scFv sequence"
EVQLVESGAEVKKPGASVKVSCKASGYTFTSYYMHWVRQAPGQGLEWMGIINPSGGSTSYAQKFQGRVTMTRDTSTSTVYMELSSLRSEDTAVYYCARGPIGCSGGSCLDYWGQGTLVTVSSGGGGSGGGGSGGGGSQSALTQPAYVSGSPGQSITISCTGTNSDVGRYNYVSWYQQHPGKAPKLMIYEVSYRPSGVSNRFSGSKSGNTASLTISGLQAEDEADYYCSSYTTSSTLDFGTGTKVTVL

SEQ ID NO: 314 - protein, 252 aa, Artificial Sequence
  source: /note="Description of Artificial Sequence: Synthetic scFv sequence"
EVQLVESGAEVKKPGESLKISCKGSGYSFTGSWIGWGRQMPGKGLEWMGIIYPGDSDTRYSPSFQGQVTISADKSISTAYLQWSSLKASDTAMYYCARGFLRGGDCCGALDIWGQGTMVTVSSGGGGSGGGGSGGGGSDIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPPWTFGQGTKLEIKR

SEQ ID NO: 315 - protein, 244 aa, Artificial Sequence
  source: /note="Description of Artificial Sequence: Synthetic scFv sequence"
EVQLVESGAEVKKPGSSVKVSCKASGGTFSSYAISWVRQAPGQGLEWMGGIIPIFGTANYAQKFQGRVTITADESTSTAYMELSSLRSEDTAVYYCARDHKVVRFGYWGQGTLVTVSSGGGGSGGGGSGGGGSHVILTQPPSASASLGASVKLTCTLSSGHSSYAIAWHQQQPEKGPRYLMKVNSDGSLSKGDGIPDRFSGSTSGAERYLTISSLQSEDEADYYCQTWGSGMAIFGGGTKLTVL

SEQ ID NO: 316 - protein, 245 aa, Artificial Sequence
  source: /note="Description of Artificial Sequence: Synthetic scFv sequence"
EVQLVESGGGLVKPGGSLKLSCAASGFAFSIYDMSWVRQTPEKRLEWVAYISSGGGTYYPDTVKGRFTISRDNAKNTLYLQMSSLKSEDTAMYYCARHSGYGSSYGVLFAYWGQGTLVTVSAGGGGSGGGGSGGGGSDIQMTQTTSSLSASLGDRVTISCRASQDISNYLNWYQQKPDGTVKLLIYYTSILHSGVPSRFSGSGSGTDYSLTISNLEQEDFATYFCQQGNTLPWTFGGGTKLEIKA

SEQ ID NO: 317 - protein, 245 aa, Artificial Sequence
  source: /note="Description of Artificial Sequence: Synthetic scFv sequence"
EVQLVESGGGLVKPGGSLKLSCAASGFAFSIYDMSWVRQTPEKRLEWVAYISSGGGTYYPDTVKGRFTISRDNAKNTLYLQMSSLKSEDTAMYYCARHSGYGTHWGVLFAYWGQGTLVTVSAGGGGSGGGGSGGGGSDIQMTQTTSSLSASLGDRVTISCRASQDISNYLNWYQQKPDGTVKLLIYYTSILHSGVPSRFSGSGSGTDYSLTISNLEQEDFATYFCQQGNTLPWTFGGGTKLEIKA

SEQ ID NO: 318 - protein, 247 aa, Artificial Sequence
  source: /note="Description of Artificial Sequence: Synthetic scFv sequence"
EVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDDFWSGSVDYWGQGTLVTVSSGGGGSGGGGSGGGGSGGGGSSYVLTQPPSVSVAPGKTATITCGGTNIGSKNVHWYQQKPGQAPVLAIYYDSDRPSGIPERFSGSNSGNTATLTISRVEAGDEADYFCQVWDSSSDHWVFGGGTKLTVL

SEQ ID NO: 319 - protein, 241 aa, Artificial Sequence
  source: /note="Description of Artificial Sequence: Synthetic scFv sequence"
EVQLVESGGGLVKPGGSLRLSCVASGFTFSNAWMNWVRQAPGKGLEWVGRIKSKTDGGTADYAAPVKGRFTISRDDSKNTMYLQMNSLKTEDTGVYYCITGATDVWGQGTTVTVSSGGGGSGGGGSGGGGSSYVLTQPPSASGTPGQRVTISCSGSSSNIGSNYVYWYQQLPGTAPKLLIYRNNQRPSGVPDRFSGSKSGTSASLAISGLRSEDEADYYCAAWDDSLSGPVFGGGTKLTVL

SEQ ID NO: 320 - protein, 247 aa, Artificial Sequence
  source: /note="Description of Artificial Sequence: Synthetic scFv sequence"
EVQLVESGGGLVQPGGSLRLSCAASGFTFSSYAMHWVRQAPGKGLEYVSAISSNGGSTYYANSVKDRFTISRDNSKNTLYLQMGSLRAEDMAVYYCARVHSSGYYHPGPNDYWGQGTLVTVSSGGGGSGGGGSGGGGSSSELTQDPAVSVALGQTVRITCQGDSLRTYYATWYQQKPGQAPVLVFYDENNRPSGIPDRFSGSSSGNTASLTITGTQAEDEADYYCSSRDSSGNPSCVFGGGTKLTVL

SEQ ID NO: 321 - protein, 247 aa, Artificial Sequence
  source: /note="Description of Artificial Sequence: Synthetic scFv sequence"
EVQLVESGGGLVQPGGSLRLSCAASGFTFSSYAMSWVRQAPGKGLEWVSYISSSSSTIYYADSVKGRFTISRDNAKNSLYLQMNSLRAEDTAVYYCARDGPIRYFDHSKAFDIWGQGTMVTVSSGGGGSGGGGSGGGGSSSELTQDPAVSVALGQTVRITCQGDSLRSYYASWYQQKPGQAPVLVIYGKNNRPSGIPDRFSGSSSGNTASLTITGAQAEDEADYYRNSRDSSGNPYVFGTGTKVTVL

SEQ ID NO: 322 - protein, 245 aa, Artificial Sequence
  source: /note="Description of Artificial Sequence: Synthetic scFv sequence"
EVQLVESGGGLVQPGRSLRLSCAASGFTFDDYAMHWVRQAPGKGLEWVSGISWNSGSIGYADSVKGRFTISRDNAKNSLYLQMNSLRAEDTALYYCAKDKGGGYYDFWSGSDYWGQGTLVTVSSGGGGSGGGGSGGGGSSSELTQDPAVSVALGQTVRITCQGDSLRSYYASWYQQKPGQAPVLVIYGKNNRPSGIPDRFSGSSSGNTASLTITGAQAEDEADYYCNSRDSSGWVFGGGTKLTVL

SEQ ID NO: 323 - protein, 246 aa, Artificial Sequence
  source: /note="Description of Artificial Sequence: Synthetic scFv sequence"
EVQLVESGGGLVQPGRSLRLSCAASGFTFDDYAMHWVRQAPGKGLEWVSGISWNSGSIGYADSVKGRFTISRDNAKNSLYLQMNSLRAEDTALYYCAKGLSSWHFHDALDIWGQGTMVTVSSGGGGSGGGGSGGGGSSSELTQDPAVSVALGQTVRITCQGDSLRSYYASWYQQKPGQAPVLVIYGKNNRPSGIPDRFSGSSSGNTASLTITGAQAEDEADYYCNSRDSSGNHLWVFGGGTKLTVL

SEQ ID NO: 324 - protein, 254 aa, Artificial Sequence
  source: /note="Description of Artificial Sequence: Synthetic scFv sequence"
QVNLRESGPALVKPTQTLTLTCTFSGFSLNTFGMSVSWIRQPPGKALEWLALIDWDDDKYYSTSLRTRLTISKDTAKNQVVLRMTNMDPMDTATYYCARIYGGDRTNTQAPYFFDLWGQGTLVTVSSGGGGSGGGGSGGGGSDVVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPWTFGQGTKLEIK

SEQ ID NO: 325 - protein, 250 aa, Artificial Sequence
  source: /note="Description of Artificial Sequence: Synthetic scFv sequence"
QVQLQESGPGLVKPSETLSLTCSVSGGSINSYYWSWIRQAPGKGLEWIAFTSHSGNVKYNPSLTGRVTIAVDTSKNQFYLEVTSVTAADTAVYFCARGLDPLFAYDAFEIWGLGTMVTVSSGGGGSGGGGSGGGGSEIVLTQSPLSLPVTPGEPASISCRSSQSLLHSNGYNYLDWYLQKPGQSPQLLIYLGSNRASGVPDRFSGSGSGTDFTLKISRVEAEDVGVYYCMQVLQTPPLTFGGGTKVDIKR

SEQ ID NO: 326 - protein, 245 aa, Artificial Sequence
  source: /note="Description of Artificial Sequence: Synthetic scFv sequence"
QVQLQESGPGLVKPSETLSLTCTVSGGSISSSSYYWGWIRQPPGKGLEWIGSIYYSGSTYYNPSLKSRVTISVDTSKNQFSLKLSSVTAADTAVYYCARGRMDTAMAQIWGQGTMVTVSSGDGGSGGGGSGGGGSNFMLTQPHSVSESPGKTVTIPCTGSSGSFASSYVQWYQQRPGSAPATVIYEDNQRPSGVPDRFSGSVDSSSNSASLTISGLKTEDEAVYYCQSYDGATWVFGGGTKLTVL

SEQ ID NO: 327 - protein, 248 aa, Artificial Sequence
  source: /note="Description of Artificial Sequence: Synthetic scFv sequence"
QVQLQESGPGLVKPSGTLSLTCAVSGASITSRHWWNWVRHSPGKGLEWIGQIYHSGTTTYNPSLGSRVTISVDKSKNQISLELRSVTAADTATYYCVRDYLELATYYGMDVWGQGTTVTVSSGGGGSGGGGSGGGGSEIVLTQSPLSLPVTPGEPASISCRSSQSLLYSDGYNYLDWYLQKPGQSPQLLIYLGSNRASGVPDRFSGSGSGTDFTLQISGVETEDVGVYYCMQALQTQSFGQGTKLEIK

SEQ ID NO: 328 - protein, 254 aa, Artificial Sequence
  source: /note="Description of Artificial Sequence: Synthetic scFv sequence"
QVQLQESGPGLVKPSQTLSLTCAISGDSVLSNSDTWNWIRQSPSRGLEWLGRTYHRSTWYDDYASSVRGRVSINVDTSKNQYSLQLNAVTPEDTGVYYCARDRLQDGNSWSDAFDVWGQGTMVTVSSGGGGSGGGGSGSGGSQSALTQPASVSGSPGQSITISCTGTSSDVGGYNYVSWYQQHPGKAPKLMIYEVSNRPSGVSNRFSGSKSGNTASLTISGLQAEDEADYYCSSYTSSSTLYVFGTGTKVTVLG

SEQ ID NO: 329 - protein, 236 aa, Artificial Sequence
  source: /note="Description of Artificial Sequence: Synthetic scFv sequence"
QVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCAREVTGDLEDAFDIWGQGTMVTVSSGGGGSDIQMTQSPSSLSASVGDRVTITCRASQTIWSYLNWYQQRPGKAPNLLIYAASSLQSGVPSRFSGRGSGTDFTLTISSLQAEDFATYYCQQSYSIPQTFGQGTKLEIK

SEQ ID NO: 330 - protein, 247 aa, Artificial Sequence
  source: /note="Description of Artificial Sequence: Synthetic scFv sequence"
QVQLVQSGAEVKKPGASVKVSCKASGYTFTGYYMHWVRQAPGQGLEWMGWINPNSGGTNYAQKFQGRVTMTRDTSISTAYMELSRLRSDDTAVYYCARDYWGYYGSGTLDYWGQGTLVTVSSGGGGSGGGGSGGGGSQSALTQPGSVSGSPGQSITISCTGTSSDVGGYNYVSWYQQHPGKAPKLIIYDVSSRPSGVSNRFSGSQSGNTASLTISGLQAEDEADYSCSSYAGSNTLVFGTGTKVTVL

SEQ ID NO: 331 - protein, 252 aa, Artificial Sequence
  source: /note="Description of Artificial Sequence: Synthetic scFv sequence"
QVQLVQSGAEVKKPGASVKVSCKASGYTFTSYDINWVRQATGQGLEWMGWMNPNSGNTGYAQKFQGRVTMTRNTSISTAYMELSSLRSEDTAVYYCARGDSNYWSYYGMDVWGQGTLVTVSSGGGGSGGGGSGGGGSGGGGSQSVLTQPRSVSGSPGQSVTISCTGTSSDVGGYNYVSWYQQHPGEAPKLIIYDADKRPSGISNRFSSGKSGNTASLTISGLQVEDEADYYCCSYAGGSTWVFGGGTKVTVL

SEQ ID NO: 332 - protein, 254 aa, Artificial Sequence
  source: /note="Description of Artificial Sequence: Synthetic scFv sequence"
QVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCARAGLALYSNYVPYYYYGMDVWGQGTTVTVSSGGGGSGGGGSGGGGSNFMLTQPHSVSESPGKTVTISCTRSSGSIASNYVQWYQQRPGSSPTTVIYEDNQRPSGVPDRFSGSIDSSSNSASLTISGLKTEDEADYYCQSYDSSNPWVFGGGTKLTVL

SEQ ID NO: 333 - protein, 247 aa, Artificial Sequence
  source: /note="Description of Artificial Sequence: Synthetic scFv sequence"
QVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCASFSSSDSYDYWGQGTLVTVSSGGGGSGGGGSGGGGSGGGGSEIVLTQSPATLSVSPGERATLSCRASQSVTSNLAWYQQKPGQAPRLLIYAASTRATGIPARFSGSGSGTEFTLTISSMQSEDFAVYFCQQYHTWPPLTFGGGTKVEIKT

SEQ ID NO: 334 - protein, 244 aa, Artificial Sequence
  source: /note="Description of Artificial Sequence: Synthetic scFv sequence"
QVQLVQSGAEVKKPGASVKVSCKASGYTFTSYYMHWVRQAPGQGLEWMGIINPSGGSTSYAQKFQGRVTMTRDTSISTAYMELSRLRSDDTAVYYCAREMDDSSGPDYWGQGTLVTVSSGGGGSGGGGSGGGGSQSALTQPASVSGSPGQSITISCTGTSSDVGGYNYVSWYQQHPGKAPKLMIYEVSNRPSGVSNRFSGSKSGNTASLTISGLQAEDEADYYCSSYTSSSTLVFGTGTKLTVL

SEQ ID NO: 335 - protein, 246 aa, Artificial Sequence
  source: /note="Description of Artificial Sequence: Synthetic scFv sequence"
QVQLVQSGAEVKKPGASVKVSCKASGYTFTSYYMHWVRQAPGQGLEWMGIINPSGGSTSYAQKFQGRVTMTRDTSTSTVYMELSSLRAEDTAVYYCARGGYGDYLDAFDIWGQGTTVTVSSGGGGSGGGGSGSGGSQSALTQPASVSGSPGQSITISCTGTSSDVGGYNYVSWYQQHPGKAPKLMIYEVSNRPSGVSNRFSGSKSGNTASLTISGLQAEDEADYYCSSYTSSSTLVFGTGTQLTVL

SEQ ID NO: 336 - protein, 246 aa, Artificial Sequence
  source: /note="Description of Artificial Sequence: Synthetic scFv sequence"
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCARDDDFWSGSGAFDIWGQGTTVTVSSGGGGSGGGGSGGGGSSSELTQDPAVSVALGQTVRITCQGDSLRSYYASWYQQKPGQAPVLVIYGKNNRPSGIPDRFSGSSSGNTASLTITGAQAEDEADYYCNSRDSSGNHPVVFGGGTKLTVL

SEQ ID NO: 337 - protein, 246 aa, Artificial Sequence
  source: /note="Description of Artificial Sequence: Synthetic scFv sequence"
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCARDGFGELSGAFDIWGQGTMVTVSSGGGGSGGGGSGGGGSQSALTQPASVSGSPGQSITISCTGTSSDVGGYNYVSWYQQHPGKAPKLMIYDVSNRPSGVSNRFSGSKSGNTASLTISGLQAEDEADYYCSSYASSSTLVFGGGTKVTVL

SEQ ID NO: 338 - protein, 247 aa, Artificial Sequence
  source: /note="Description of Artificial Sequence: Synthetic scFv sequence"
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCARDLAAAGNYYYYGMDVWGQGTTVTVSSGGGGSGGGGSGGGGSSSELTQDPAVSVALGQTARITCQGDSLRSYFTSWYHQKPGQAPVLVIYGNNNRPSGIPDRFSGSSSGNTASLTITGAQAEDEGDYYCDSRDSSGDHLVFGGGTKLTVL

SEQ ID NO: 339 - protein, 242 aa, Artificial Sequence
  source: /note="Description of Artificial Sequence: Synthetic scFv sequence"
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCARDLDVSLDIWGQGTMVTVSSGGGGSGGGGSGGGGSQSALTQPASVSGSPGQSITISCSGTSSDVGGYNSVSWYQQYPGKAPKLMIYDVNNRPSGVSSRFSGSKSGNTASLTISGLQAEDEADYYCSSYTSSSTLFFGAGTKVTVL

SEQ ID NO: 340 - protein, 250 aa, Artificial Sequence
  source: /note="Description of Artificial Sequence: Synthetic scFv sequence"
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCAREDDSSGYTSPFDYWGQGTLVTVSSGGGGSGGGGSGGGGSGGGRSSYELTQPPSVSVAPGETASIACGGHNIRSKNVHWYQQKPGQAPVLVISYDGDRPSGIPERFSGSNLGSTATLTISRVEAGDEADYYCQVWDSDSDHYVFGTGTKVTVL

SEQ ID NO: 341 - protein, 241 aa, Artificial Sequence
  source: /note="Description of Artificial Sequence: Synthetic scFv sequence"
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCARGDYYMDVWGKGTTVTVSSGGGGSGGGGSGGGGSQSALTQPASASGSPGQSVTISCTGTSSDVGGYNYVSWYQQHPGKAPKLMIYEVSKRPSGVPDRFSGSKSGNTASLTISGLQAEDEADYYCSSYTSSGTLVFGGGTKLTVL

SEQ ID NO: 342 - protein, 245 aa, Artificial Sequence
  source: /note="Description of Artificial Sequence: Synthetic scFv sequence"
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCARGSGSLGDAFDIWGQGTMVTVSSGGGGSGGGGSGGGGSQSALTQPASVSGSPGQSITISCTGSSSDVGGYNYVSWYQQHPGKAPKLMIYEVSNRPSGVSNRFSGSKSGNTASLTISGLQAEDEADYYCSSYTSSSTLVFGTGTKVTVL

SEQ ID NO: 343 - protein, 246 aa, Artificial Sequence
  source: /note="Description of Artificial Sequence: Synthetic scFv sequence"
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCARGSYGDYGDAFDIWGQGTTVTVSSGGGGSGGGGSGSGGSQSALTQPASVSGSPGQSITISCTGTSSDVGGYKYVSWYQQHPGKAPKLMIYDVSNRPSGVSNRFSGSKSGNTASLTISGLQAEDEADYYCSSYTSSSTLVFGGGTKLTVL

SEQ ID NO: 344 - protein, 248 aa, Artificial Sequence
  source: /note="Description of Artificial Sequence: Synthetic scFv sequence"
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCARPEGVSYYDSSVLDYWGQGTLVTVSSGGGGSGGGGSGGGGSQSALTQPASVSGSPGQSITISCTGTSSDVGGYKHVSWYQHHPGKAPKLMIYDVSNRPSGVSNRFSGSKSGNTASLTVSGLQAEDEAHYYCVSYRNFNSLVFGTGTKVTVL

SEQ ID NO: 345 - protein, 251 aa, Artificial Sequence
  source: /note="Description of Artificial Sequence: Synthetic scFv sequence"
QVQLVQSGGGLIQPGGSLRLSCAASGFTVSSNYMSWVRQAPGKGLEWVSVIYSGGSTYYADSVKGRFTISRDNSKNTLYLQMNSLRAEDTAVYYCASQSTPYDSSGYYSGDAFDIWGQGTMVTVSSGGGGSGGGGSGGGGSSYVLTQPPSASGTPGQRVTISCSGSSSNIGSNYVYWYQQLPGTAPKLLIYRNNQRPSGVPDRFSGSKSGTSASLAISGLRSEDEADYYCAAWDDSLSGYVFGTGTKLTVL

SEQ ID NO: 346 - protein, 250 aa, Artificial Sequence
  source: /note="Description of Artificial Sequence: Synthetic scFv sequence"
QVQLVQSGGGVVQPGRSLRLSCAASGFTFSSYAMSWVRQAPGKGLEWVSAISGSGGSTYYADSVKGRFTISRDNSKNTLYLQMNSLRAEDTAVYYCAKEPLFGVVEEDVDYWGQGTLVTVSSGGGGSGGGGSGGGGSDVVMTQSPLSLPVTPGEPASISCRSSQSLLAGNGHNYLDWYLQKPGQSPQLLIYLGSNRASGVPDRFSGSGSGTDFTLKISRVEAEDVGVYYCMQALQNPLTFGGGTKLEIKR

SEQ ID NO: 347 - protein, 244 aa, Artificial Sequence
  source: /note="Description of Artificial Sequence: Synthetic scFv sequence"
EVQLVESGGGLVQPGGSLRLSCAASGFTFSSFGMHWVRQAPGKGLEWVAYISSDSSAIYYADTVKGRFTISRDNAKNSLYLQMNSLRDEDTAVYYCGRGRENIYYGSRLDYWGQGTTVTVSSGGGGSGGGGSGGGGSDIQLTQSPSFLSASVGDRVTITCKASQNVDTNVAWYQQKPGKAPKALIYSASYRYSGVPSRFSGSGSGTDFTLTISSLQPEDFATYYCQQYNNYPFTFGQGTKLEIK

SEQ ID NO: 348 - protein, 248 aa, Artificial Sequence
  source: /note="Description of Artificial Sequence: Synthetic scFv sequence"
QVQLQQSGAEVKKPGSSVKVSCKASGGTFSSYAISWVRQAPGQGLEWMGGIIPILGIANYAQKFQGRVTITADESTSTAYMELSSLRSEDTAVYYCARGGAGGSGSYYPLIWGQGTTVTVSSGGGGSGGGGSGGGGSEIVLTQSPATLSLSPGERATLSCGASQSVSSSYLAWYQQKPGQAPRLLIYDASSRATGIPARFSGSGSGTDFTLTISSLEPEDFAVYYCQQRSSWPPTWTFGQGTKLEIKR

SEQ ID NO: 349 - protein, 244 aa, Artificial Sequence
  source: /note="Description of Artificial Sequence: Synthetic scFv sequence"
QVQLQQSGAEVKKPGSSVKVSCKASGGTFSSYAISWVRQAPGQGLEWMGGIIPILGIANYAQKFQGRVTITADESTSTAYMELSSLRSEDTAVYYCATGGSGRYALDIWGQGTMVTVSSGGGGSGGGGSGGGGSEIVLTQSPATLSLSPGERATLSCRASQSVSSYLAWYQQKPGQAPRLLIYDASNRATGIPARFSGSGSGTDFTLTISSLEPEDFAVYYCQQRSNWPPSYTFGQGTKLEIKR

SEQ ID NO: 350 - protein, 242 aa, Artificial Sequence
  source: /note="Description of Artificial Sequence: Synthetic scFv sequence"
QVQLVQSGAEVKKPGSSVKVSCKASGGTFSSYAISWVRQAPGQGLEWMGGIIPILGTANYAQKFQGRVTITADESTSTAYMELSSLRSEDTAVYYCARWGGGAFDIWGQGTMVTVSSGGGGSGGGGSGGGGSEIVLTQSPGTLSLSPGERATLSCRASQSVGGYLAWYQQKPGQAPRLLIYDASNRATGIPARFSGSGSGTDFTLTISSLEPEDFAVYYCQQRNNWPPMYTFGQGTKLEIKR

SEQ ID NO: 351 - protein, 406 aa, Artificial Sequence
  source: /note="Description of Artificial Sequence: Synthetic scFv sequence"
QEDERIVLVDNKCKCARISRIIRSSEDPNEDIVERIRIIVPLNNREISDPSPLRTRFVYHLSDLCKKCDPTEVELDNQIVTATQSNICDEDSATETCYTYDRNKCYTAVVPLVYGGETKMVETALTPDACYPDGGGGSGGGGSGGGGSQVQLQQSGAELARPGASVKMSCKASGYTFTRYTMHWVKQRPGQGLEWIGYINPSRGYTNYNQKFKDKATLTTDKSSSTAYMQLSSLTSEDSAVYYCARYYDDHYSLDYWGQGTTLTVSSGGGGSGGGGSGGGGSQIVLTQSPAIMSASPGEKVTMTCSASSSVSYMNWYQQKSGTSPKRWIYDSKLASGVPAHFRGSGSGSYSLISGMEAEDAATYYCQQWSSNPFTFGSGTKLEIKEQKLISEEDLNSAVDHHHHHH

SEQ ID NO: 352 - protein, 558 aa, Artificial Sequence
  source: /note="Description of Artificial Sequence: Synthetic scFv sequence"
QVQLQQWGAGLLKPSETLSLTCAVYGGSFSGYYWSWIRQPPGKGLEWIGEINHSGSNYNPSLKSRVISVDSKNQFSLKLSSVTAADTAVYYCARGRMAWGASVNFDYWGQGTLVTVSSGSASAPTLFPLVSCENSPSDSSVAVGCLAQDFLPDSITFSWKYKNNSDISSTRGFPSVLRGGKYAASQVLLPSKDVMQGTDEHVVCKVQHPNGNKEKNVPLPVIAELPPKVSVFVPPRDGFFGNPRKSKLICQATGFSPRQIQVSWLREGKQVGSGVTTDQVQAEAKESGPTTYKVTSTLTIKESDWLSQSMFTCRVDHRGLTFQQNASSMCVPDQDTAIRVFAIPPSFASIFLTKSKLTCLVTDLTYDSVISWTRQNGEAVKTHTISESHPNAFSAVGEASICEDDWNSGERFTCTVTHDLPSPLKQISRPKGVALHRPDVYLLPPAREQLNLRESAICLVTGFSPADVFVQWMQRGQPLSPEKYVSAPMPEPQAPGRYFAHSILTVSEEEWNTGEYTCVVAHEALPNRVTERTVDKSTGKPTLYNVSLVMSDTAGTCY

SEQ ID NO: 353 - protein, 246 aa, Artificial Sequence
  source: /note="Description of Artificial Sequence: Synthetic scFv sequence"
LLHESGAEVAKPGASVKMSCKASGYTFTTYWMHWIKQRPGQGLEWIGYINPSTGYTDYNQNFKDKATLTADKSSRTAYMQLSSLTSEDSTVYYCTRRGPSYGNHGAWFPYWGQGTLVTVSAVSSGGGGSGGGGSGGGGSTNIVMTQSPRSMSMSVGERVTLSCKASENVDTYVSWYQQKPEQSPKLLIYGASNRYTGVPDRFTGSGSATDFTLTISSVQAEDLADYHCGQSYRYPPTFGGGTKLEI

SEQ ID NO: 354 - protein, 252 aa, Artificial Sequence
  source: /note="Description of Artificial Sequence: Synthetic scFv sequence"
RMAQVQLQQSGAELARPGASVKMSCKASGYTFTTYTIHWVRRRPGHDLEWIGYINPSSGCSDYNQNFKGKTTLTADKSSNTAYMQLNSLTSEDSAVYYCARRADYGNYEYTWFAYWGQGTTVTVSSSGGGSGGGGSGGGGSVIELTQSPKFMSTSVGDRVNVTYKASQNVGTNVAWFQQKPGQSPKVLIYSASYRYSGVPDRFTGSGSGTDFTLTISNVQSEDLAEYFCQQYHTYPLTFGGGTKLEIKRSDP

SEQ ID NO: 355 - protein, 246 aa, Artificial Sequence
  source: /note="Description of Artificial Sequence: Synthetic scFv sequence"
EIVLTQSPGSLAVSPGERVTMSCKSSQSVFFSSSQKNYLAWYQQIPGQSPRLLIYWASTRESGVPDRFTGSGSGTDFTLTISSVQPEDLAIYYCHQYLSSRTFGQGTKLEIKRGGGGSGGGGSSGGGSQVQLQQPGAEVVKPGASVKMSCKASGYTFTSYYIHWIKQTPGQGLEWVGVIYPGNDDISYNQKFQGKATLTADKSSTTAYMQLSSLTSEDSAVYYCAREVRLRYFDVWGQGTTVTVSS

SEQ ID NO: 356 - protein, 245 aa, Artificial Sequence
  source: /note="Description of Artificial Sequence: Synthetic scFv sequence"
EVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCAKETDYYGSGTFDYWGQGTLVTVSSASGGGGSGGGGSGGGGSDIQMTQSPSSLSASVGDRVTISCRASQGIGIYLAWYQQRSGKPPQLLIHGASTLQSGVPSRFSGSGSGTDFTLTISSLQPEDFASYWCQQSNNFPPTFGQGTKVEIK

SEQ ID NO: 357 - protein, 267 aa, Artificial Sequence
  source: /note="Description of Artificial Sequence: Synthetic scFv sequence"
MALPVTALLLPLALLLHAARPEVQLQQSGPELVKPGASVKISCKASGYTFTDYNMHWVKQSHGKSLEWIGYIYPYNGGTGYNQKFKSKATLTVDNSSSTAYMDVRSLTSEDSAVYYCARGRPAMDYWGQGTSVTVSSGGGGSGGGGSGGGGSDIVLTQSPASLAVSLGQRATISCRASESVDNYGISFMNWFQQKPGQPPKLLIYAASNQGSGVPARFSGSGSGTDFSLNIHPMEEDDTAMYFCQQSKEVPWTFGGGTKLEIKRSDP

SEQ ID NO: 358 - protein, 266 aa, Artificial Sequence
  source: /note="Description of Artificial Sequence: Synthetic scFv sequence"
MALPVTALLLPLALLLHAARPEVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCAKETDYYGSGTFDYWGQGTLVTVSSASGGGGSGGGGSGGGGSDIQMTQSPSSLSASVGDRVTISCRASQGIGIYLAWYQQRSGKPPQLLIHGASTLQSGVPSRFSGSGSGTDFTLTISSLQPEDFASYWCQQSNNFPPTFGQGTKVEIK

SEQ ID NO: 359 - protein, 272 aa, Artificial Sequence
  source: /note="Description of Artificial Sequence: Synthetic scFv sequence"
MALPVTALLLPLALLLHAARPQVQLVQSGAEVKKPGASVRVSCKASGYIFTNYYVHWVRQAPGQGLEWMGIISPSGGSPTYAQRLQGRVTMTRDLSTSTVYMELSSLTSEDTAVYFCARESRLRGNRLGLQSSIFDHWGQGTLVTVSSASGGGGSGGGGSGGGGSDIRMTQSPPSLSASVGDRVTIPCQASQDINNHLNWYQQKPGKAPQLLIYDTSNLEIGVPSRFSGSGSGTDFTLTISSLQPEDIATYYCQQYENLPLTFGGGTKVEIK

SEQ ID NO: 360 - protein, 266 aa, Artificial Sequence
  source: /note="Description of Artificial Sequence: Synthetic scFv sequence"
MALPVTALLLPLALLLHAARPQVQLVQSGAEVKKPGASVRVSCKASGYMFTDFFIHWVRQAPGQGLEWMGWINPNSGVTKYAQKFQGRVTMTRNTSISTAYMELSSLRSEDTAVYYCATWYSSGWYGIANIWGQGTMVTVSSASGGGGSGGGGSGGGGSDIQLTQSPSSLSASVGDRVTITCQASHDISNYLHWYQQKPGKAPKLLIYDASNLETGVPSRFTGSGSGTDFTLTIRSLQPEDVAAYYCQQSDDLPHTFGQGTKVDIK

SEQ ID NO: 361 - protein, 265 aa, Artificial Sequence
  source: /note="Description of Artificial Sequence: Synthetic scFv sequence"
MALPVTALLLPLALLLHAARPQVQLVQSGAEVKKPGESLKISCKGSGYSFTNYWIGWVRQMPGKGLEWMGIIYPGDSDTRYSPSFQGQVTISADKSISTAYLQWSSLKASDTAMYYCARHGPSSWGEFDYWGQGTLVTVSSASGGGGSGGGGSGGGGSDIRLTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVDIK

SEQ ID NO: 362 - protein, 271 aa, Artificial Sequence
  source: /note="Description of Artificial Sequence: Synthetic scFv sequence"
MALPVTALLLPLALLLHAARPQVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARLGGSLPDYGMDVWGQGTMVTVSSASGGGGSGGGGSGGGGSEIVLTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTLITFGQGTKVDIK

SEQ ID NO: 363 - protein, 271 aa, Artificial Sequence
  source: /note="Description of Artificial Sequence: Synthetic scFv sequence"
MALPVTALLLPLALLLHAARPQVQLVQSGAEVKKPGESLKISCKGSGYSFTSYWIGWVRQMPGKGLEWMGIIYPGDSDTRYSPSFQGQVTISADKSITTAYLQWSSLRASDSAMYYCARGGYSDYDYYFDFWGQGTLVTVSSASGGGGSGGGGSGGGGSEIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPFTFGGGTKVEIK

SEQ ID NO: 364 - protein, 261 aa, Artificial Sequence
  source: /note="Description of Artificial Sequence: Synthetic scFv sequence"
MALPVTALLLPLALLLHAARPQVQLVQSGGDLAQPGRSLRLSCAASGFTFDDYAMHWVRQAPGKGLEWVAVIWPDGGQKYYGDSVKGRFTVSRDNPKNTLYLQMNSLRAEDTAIYYCVRHFNAWDYWGQGTLVTVSSASGGGGSGGGGSGGGGSDIQLTQSPSSLSAYVGGRVTITCQASQGISQFLNWFQQKPGKAPKLLISDASNLEPGVPSRFSGSGSGTDFTFTITNLQPEDIATYYCQQYDDLPLTFGGGTKVEIK

SEQ ID NO: 365 - protein, 270 aa, Artificial Sequence
  source: /note="Description of Artificial Sequence: Synthetic scFv sequence"
MALPVTALLLPLALLLHAARPQVQLVQSGGGLVQPGGSLRLSCAASGFTFSSYAMSWVRQAPGKGLEWVSAISGSGGSTYYADSVKGRFTISRDNSKNTLYLQMNSLRAEDTAVYYCAKEDTIRGPNYYYYGMDVWGQGTTVTVSSASGGGGSGGGGSGGGGSETTLTQSPSSVSASVGDRVSITCRASQDIDTWLAWYQLKPGKAPKLLMYAASNLQGGVPSRFSGSGSGTDFILTISSLQPEDFATYYCQQASIFPPTFGGGTKVDIK

SEQ ID NO: 366 - protein, 269 aa, Artificial Sequence
  source: /note="Description of Artificial Sequence: Synthetic scFv sequence"
MALPVTALLLPLALLLHAARPQVQLVQSGGGVVQPGKSLRLSCAASGFTFSIFAMHWVRQAPGKGLEWVATISYDGSNAFYADSVEGRFTISRDNSKDSLYLQMDSLRPEDTAVYYCVKAGDGGYDVFDSWGQGTLVTVSSASGGGGSGGGGSGGGGSEIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPTFGPGTKVDIK

SEQ ID NO: 367 - protein, 246 aa, Artificial Sequence
  source: /note="Description of Artificial Sequence: Synthetic scFv sequence"
NIMLTQSPSSLAVSAGEKVTMSCKSSQSVFFSSSQKNYLAWYQQIPGQSPKLLIYWASTRESGVPDRFTGSGSGTDFTLTISSVQSEDLAIYYCHQYLSSRTFGGGTKLEIKRGGGGSGGGGSSGGGSQVQLQQPGAEVVKPGASVKMSCKASGYTFTSYYIHWIKQTPGQGLEWVGVIYPGNDDISYNQKFKGKATLTADKSSTTAYMQLSSLTSEDSAVYYCAREVRLRYFDVWGAGTTVTVSS

SEQ ID NO: 368 - protein, 251 aa, Artificial Sequence
  source: /note="Description of Artificial Sequence: Synthetic scFv sequence"
QVQLVQSGAEVKKPGASVRVSCKASGYIFTNYYVHWVRQAPGQGLEWMGIISPSGGSPTYAQRLQGRVTMTRDLSTSTVYMELSSLTSEDTAVYFCARESRLRGNRLGLQSSIFDHWGQGTLVTVSSASGGGGSGGGGSGGGGSDIRMTQSPPSLSASVGDRVTIPCQASQDINNHLNWYQQKPGKAPQLLIYDTSNLEIGVPSRFSGSGSGTDFTLTISSLQPEDIATYYCQQYENLPLTFGGGTKVEIK

SEQ ID NO: 369 - protein, 245 aa, Artificial Sequence
  source: /note="Description of Artificial Sequence: Synthetic scFv sequence"
QVQLVQSGAEVKKPGASVRVSCKASGYMFTDFFIHWVRQAPGQGLEWMGWINPNSGVTKYAQKFQGRVTMTRNTSISTAYMELSSLRSEDTAVYYCATWYSSGWYGIANIWGQGTMVTVSSASGGGGSGGGGSGGGGSDIQLTQSPSSLSASVGDRVTITCQASHDISNYLHWYQQKPGKAPKLLIYDASNLETGVPSRFTGSGSGTDFTLTIRSLQPEDVAAYYCQQSDDLPHTFGQGTKVDIK

SEQ ID NO: 370 - protein, 244 aa, Artificial Sequence
  source: /note="Description of Artificial Sequence: Synthetic scFv sequence"
QVQLVQSGAEVKKPGESLKISCKGSGYSFTNYWIGWVRQMPGKGLEWMGIIYPGDSDTRYSPSFQGQVTISADKSISTAYLQWSSLKASDTAMYYCARHGPSSWGEFDYWGQGTLVTVSSASGGGGSGGGGSGGGGSDIRLTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVDIK

SEQ ID NO: 371 - protein, 250 aa, Artificial Sequence
  source: /note="Description of Artificial Sequence: Synthetic scFv sequence"
QVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARLGGSLPDYGMDVWGQGTMVTVSSASGGGGSGGGGSGGGGSEIVLTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTLITFGQGTKVDIK

SEQ ID NO: 372 - protein, 250 aa, Artificial Sequence
  source: /note="Description of Artificial Sequence: Synthetic scFv sequence"
QVQLVQSGAEVKKPGESLKISCKGSGYSFTSYWIGWVRQMPGKGLEWMGIIYPGDSDTRYSPSFQGQVTISADKSITTAYLQWSSLRASDSAMYYCARGGYSDYDYYFDFWGQGTLVTVSSASGGGGSGGGGSGGGGSEIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPFTFGGGTKVEIK

SEQ ID NO: 373 - protein, 240 aa, Artificial Sequence
  source: /note="Description of Artificial Sequence: Synthetic scFv sequence"
QVQLVQSGGDLAQPGRSLRLSCAASGFTFDDYAMHWVRQAPGKGLEWVAVIWPDGGQKYYGDSVKGRFTVSRDNPKNTLYLQMNSLRAEDTAIYYCVRHFNAWDYWGQGTLVTVSSASGGGGSGGGGSGGGGSDIQLTQSPSSLSAYVGGRVTITCQASQGISQFLNWFQQKPGKAPKLLISDASNLEPGVPSRFSGSGSGTDFTFTITNLQPEDIATYYCQQYDDLPLTFGGGTKVEIK

SEQ ID NO: 374 - protein, 249 aa, Artificial Sequence
  source: /note="Description of Artificial Sequence: Synthetic scFv sequence"
QVQLVQSGGGLVQPGGSLRLSCAASGFTFSSYAMSWVRQAPGKGLEWVSAISGSGGSTYYADSVKGRFTISRDNSKNTLYLQMNSLRAEDTAVYYCAKEDTIRGPNYYYYGMDVWGQGTTVTVSSASGGGGSGGGGSGGGGSETTLTQSPSSVSASVGDRVSITCRASQDIDTWLAWYQLKPGKAPKLLMYAASNLQGGVPSRFSGSGSGTDFILTISSLQPEDFATYYCQQASIFPPTFGGGTKVDIK

SEQ ID NO: 375 - protein, 248 aa, Artificial Sequence
  source: /note="Description of Artificial Sequence: Synthetic scFv sequence"
QVQLVQSGGGVVQPGKSLRLSCAASGFTFSIFAMHWVRQAPGKGLEWVATISYDGSNAFYADSVEGRFTISRDNSKDSLYLQMDSLRPEDTAVYYCVKAGDGGYDVFDSWGQGTLVTVSSASGGGGSGGGGSGGGGSEIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPTFGPGTKVDIK

SEQ ID NO: 376 - protein, 511 aa, Artificial Sequence
  source: /note="Description of Artificial Sequence: Synthetic scFv sequence"
QVQLVQSGAEVKKPGESVKVSCKASGYTFTNYGMNWVKQAPGQGLEWMGWINTYTGEPTYADKFQGRVTMTTDTSTSTAYMEIRNLGGDDTAVYYCARWSWSDGYYVYFDYWGQGTSVTVSSGGGGSGGGGSGGGGSDIVMTQSPDSLTVSLGERTTINCKSSQSVLDSSTNKNSLAWYQQKPGQPPKLLLSWASTRESGIPDRFSGSGSGTDFTLTIDSPQPEDSATYYCQQSAHFPITFGQGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLHHHHHH

SEQ ID NO: 377 - protein, 728 aa, Artificial Sequence
  source: /note="Description of Artificial Sequence: Synthetic scFv sequence"
QVQLVQSGAEVKKPGESVKVSCKASGYTFTNYGMNWVKQAPGQGLEWMGWINTYTGEPTYADKFQGRVTMTTDTSTSTAYMEIRNLGGDDTAVYYCARWSWSDGYYVYFDYWGQGTSVTVSSGGGGSGGGGSGGGGSDIVMTQSPDSLTVSLGERTTINCKSSQSVLDSSTNKNSLAWYQQKPGQPPKLLLSWASTRESGIPDRFSGSGSGTDFTLTIDSPQPEDSATYYCQQSAHFPITFGQGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVTTLPPSREEMTKNQVSLTCLVKGFYPSDIAVEWESNGQPENNYDTTPPVLDSDGSFFLYSDLTVDKSRWQQGNVFSCSVMHEALHNHYTQKSLSLSPGKHHHHHH

SEQ ID NO: 378 - protein, 728 aa, Artificial Sequence
  source: /note="Description of Artificial Sequence: Synthetic scFv sequence"
QVQLVQSGAEVKKPGESVKVSCKASGYTFTNYGMNWVKQAPGQGLEWMGWINTYTGEPTYADKFQGRVTMTTDTSTSTAYMEIRNLGGDDTAVYYCARWSWSDGYYVYFDYWGQGTSVTVSSGGGGSGGGGSGGGGSDIVMTQSPDSLTVSLGERTTINCKSSQSVLDSSTNKNSLAWYQQKPGQPPKLLLSWASTRESGIPDRFSGSGSGTDFTLTIDSPQPEDSATYYCQQSAHFPITFGQGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVTTLPPSREEMTKNQVSLTCLVKGFYPSDIAVEWESNGQPENNYDTTPPVLDSDGSFFLYSDLTVDKSRWQQGNVFSCSVMHEALHNHYTQKSLSLSPGKHHHHHH

SEQ ID NO: 379 - protein, 214 aa, Artificial Sequence
  source: /note="Description of Artificial Sequence: Synthetic scFv sequence"
DIQMTQSPSSLSVSVGERVTITCRASENIRSNLAWYQQKPGKSPKLLVNVATNLADGVPSRFSGSGSGTDYSLKINSLQPEDFGTYYCQHYWGTTWTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 380 - protein, 115 aa, Artificial Sequence
  source: /note="Description of Artificial Sequence: Synthetic scFv sequence"
QVQVQESGPGLVAPSQTLSITCTVSGFSLTTSGVSWVRQPPGKGLEWLGVIWGDGSTNYHSSLKSRLSIKKDHSKSQVFLKLNSLTAADTATYYCAKGGYSLAHWGQGTLVTVSS

SEQ ID NO: 381 - protein, 68 aa, Artificial Sequence
  source: /note="Description of Artificial Sequence: Synthetic scFv sequence"
FWVLVVVGGVLACYSLLVTVAFIIFWVRSKRSRLLHSDYMNMTPRRPGPTRKHYQPYAPPRDFAAYRS

SEQ ID NO: 382 - protein, 234 aa, Artificial Sequence
  source: /note="Description of Artificial Sequence: Synthetic scFv sequence"
QVNLRESGGGLVQPGGFLRLSCAAFGFTFSGYWMSWVHPAPGKGLEWVANIKQDGSEKFYVDSVKGRFTISRDNAKNSLFLQMNSLRAEDTAVYFCARGLLSDYWGQGTLVPVSSGGGGSGGGGSGGGGSNFMLTQPPSVSVAPGKTASLTCGGYNIGTKSVHWYQQKPGQAPWWHDDSDRPSGIPERFSGSNSGTTATLIIRVEAGDEADYYCQAWDSISEEWFGGGTKLTVL

SEQ ID NO: 383 - protein, 243 aa, Artificial Sequence
  source: /note="Description of Artificial Sequence: Synthetic scFv sequence"
QVQLLESGGGWQPGTSLRLSCAASGFTFSNYAINWVRQAAGKGLEWVSGISGSGVSTSYADSVKGRFTVSRDNSKNTLYLQMNSLRVEDTALYYCAKNGGGPEYLQHWGQGTLVTVSSGGGGSGGGGSGGGGSQSVLTQPPSASGTPGQRVTISCSGSSSNIGNNTVNWSRQLPGTAPKLLIYSNDQRPSGVPDRFSGSKSGTSASLAITGLQPEDEADYYCGTWDSSLSAYVFGTGTKLTVL

SEQ ID NO: 384 - protein, 240 aa, Artificial Sequence
  source: /note="Description of Artificial Sequence: Synthetic scFv sequence"
QVQLLQSAGGLVQPGGSLRLSCAASGFTFSTYAMNWVRQAPGKGLEWVSGISGSGGSTNYADSVKGRFTISRDSSKNTLFLQMNSLRAEDTAVYYCAKDYGSGWYDYWGQGTLVTVSSGGGGSGGGGSGGGGSSSELTQDPAVSVALGQTVRITCQGDSLRSYYASWYQERPGQAPLLVIYGRNERPSGIPDRFSASSSGNTASLTITGAQAEDEADYYCQVWDSFNEQWFGGGTKLTVL

SEQ ID NO: 385 - protein, 245 aa, Artificial Sequence
  source: /note="Description of Artificial Sequence: Synthetic scFv sequence"
QVQLLQSGGGLVQPGGSLRLSCAASGFTFSSYAMSWVRQAPGKGLEWVSAISGSGGSTYYTDSVKGRFTISRDNSKNTLYLQMNSLRAEDTAVYYCAKSHDYGDYAGFDYWGQGTLVTVSSGGGGSGGGGSGGGGSHVILTQDPAVSVALGQTVRITCQGDSLKSYYASWYQQKPGQAPVLVIYGKNNRPSGIPDRFSGSSSGTTASLTITGAQAEDEADYYCHSRDSSGTHLRVFGGGTKLTVL

SEQ ID NO: 386 - protein, 241 aa, Artificial Sequence
  source: /note="Description of Artificial Sequence: Synthetic scFv sequence"
QVQLQESGGGLVKPGESLRLSCAASGFTFSDHYMDWVRQAPGKGLEWVAYIRYDGSTKYYADSVKGRFTISRDNSKNTLYLQMNSLRPEDTAFYYCARLIAEAEGWFDPWGQGTLVTVSSGGGGSGGGGSGGGGSNFMLTQPPSVSVAPGKTARITCGGNNIGSKSVYWYQQKPGQAPVLWYDDSDRPSGIPERFSGSNSGNTATLTISRVEAGDEADYYCQVWDSSSDHWFGGGTKVTVL

SEQ ID NO: 387 - protein, 242 aa, Artificial Sequence
  source: /note="Description of Artificial Sequence: Synthetic scFv sequence"
QVQLQESGGGLVKPGGPLRLSCAASGFTFSSYGMYWVRQAPGKGLEWVSTLSRSGSGTYYADSVKGRFTISRBNSKNTLYLQMNSLRAEDTAVYYCASIAVAGNYFDYWGQGTLVTVSSGGGGSGGGGSGGGGSSYVLTQDPAVSVALGQTVRITCQGDSLRSYYASWYQERPGQAPLLVIYGKNNRPSGIPDRFSGSNSGSTATLTISRVEAGDEGDYYCQVWDSINEQVVFGGGTKVTVL

SEQ ID NO: 388 - protein, 241 aa, Artificial Sequence
  source: /note="Description of Artificial Sequence: Synthetic scFv sequence"
QVQLQESGGGLVKPGGPLRLSCAASGFTFSSYGMYWVRQAPGKGLEWVSTLSRSGSGTYYAESVKGRFTISRDNSKNTLYFQMNSLRAEDTAVYYCASIAVAGNYFEYWGQGTLVTVSSGGGGSGGGGSGGGGSSYVLTQDPAVSVALGQTVRITCQGDSLRSYYASWYQERPGQAPLLVIYGKNNRPSGIPDRFSGSNSGSTATLTISRVEAGDEGDYYCQVWDSINEQWFGGGTKVTVL

SEQ ID NO: 389 - protein, 244 aa, Artificial Sequence
  source: /note="Description of Artificial Sequence: Synthetic scFv sequence"
QVQLQESGGGLVKPGGSLRLSCAASGFTFSNAWMNWVRQAPGKGLEWVGRIKSKTDEGTTDYAAPVKGRFSISRDDSKNTLYLQMNSLKTEDTGVYYCTATKGLGGSKLGQGTLVTVSSGGGGSGGGGSGGGGSQSVLTQPPSASGTPGQRVTISCSGSSSNIGNNTVNWSRQLPGTAPKLLIYSNDQRPSGVPDRFSGSKSGTSASLAITGLQPEDEADYYCGTWDSSLSAYVFGTGTKLTVL

SEQ ID NO: 390 - protein, 245 aa, Artificial Sequence
  source: /note="Description of Artificial Sequence: Synthetic scFv sequence"
QVQLQESGGGLVKPGGSLRLSCAASGFTSSSYAMHWVRQAPGKGLEYVSAIGGNGGTYYADSVKGRFTISRDNSKNTLYLQMNSLRAEDTAVYYCAKEGEQWLEYRYYYGMDVWGQGTTVTVSSGGGGSGGGGSGGGGSSSELTQDPAVSVALGQTVRITCQGDSLRSYYASWYQQKPGQAPSLVIYGENSRPSGIPDRFSGSSSGNTASLTITGAQAENEADYYCQAWDSSTAWFGGGTKLTVL

SEQ ID NO: 391 - protein, 243 aa, Artificial Sequence
  source: /note="Description of Artificial Sequence: Synthetic scFv sequence"
QVQLQESGGGLVQLGGSLRLSCAASGFTFSSYAMSWVRQAPGKGLEWVSAISGSGGSTYYADSVKGRFTISRDNSKNTLYLQMSSLRAEDTAFYYCANSAYTGGWYDYWGHGTLVTVSSGGGGSGGGGSGGGGSSSELTQDPAVSVALGQTVKITCQGDSLRTYYASWYQQRPGQAPVLVIYGENSRPSGIPDRFSGSSSGNTASLTITGAQAEDEADYYCNSRDSSGNHLRVFGGGTKLTVL

SEQ ID NO: 392 - protein, 245 aa, Artificial Sequence
  source: /note="Description of Artificial Sequence: Synthetic scFv sequence"
QVQLQESGGGLVQPGGSLRLSCAASGFTFSSYAMSWVRQAPGKGLEWVAVISYDGSNKYYADSVKGRFTISRDNSKNTLYLQMNSLRAEDTAVYYCVRGDRSYGAEYFQHWGQGTLVTVSSGGGGSGGGGSGGGGSSSELTQDPAVSVASGQTVRITCQGDSLRSYYASWYQQKPGQAPLLVIYGKNIRPSGIPDRFSGSTSGNSASLTITGAQAEDEADYYCNSRDSSGNRNWVFGGGTKLTVL

SEQ ID NO: 393 - protein, 238 aa, Artificial Sequence
  source: /note="Description of Artificial Sequence: Synthetic scFv sequence"
QVQLQESGGGLVQPGGSLRLSCAASGTFSSYAMHWVRQAPGKGLEWVAVISYDGSNKYYADSVKGRFTISRDNSKNTLYLQMNSLRAEDTAVYYCARFSSGWYYFDYWGQGTLVTVSSGGGGSGGGGSGGGGSDIQMTQSPSFLSASVGDRITITCRASNDISSYFAWYQQKPGKAPKPLIYAASTLQSGVPSRFSGSGTEFTLTISSLQPEDFATYYCQQLGSYPLTFGGGTKLEIK

SEQ ID NO: 394 - protein, 239 aa, Artificial Sequence
  source: /note="Description of Artificial Sequence: Synthetic scFv sequence"
QVQLQESGGGLVQPGGSLRLSCSASGFTFGTYAMRWVRQTSGKGLEWVSGIGVSGDAYYTDSVRGRFTISRDNSKNTLYLQMNTLRAEDTAYYCTRKSSTTSNDYWGRGTLVTVSSGGGGSGGGGSGGGGSSYVLTQDPAVSVALGQTVRITCQGDNIGSKSVHWYQQKPGQAPVLVVYDDSDRPSGIPERFSGSNSGTTATLTISSVEAGDEADYYCQAWDSISEHVIFGGGTKVTVL

SEQ ID NO: 395 - protein, 237 aa, Artificial Sequence
  source: /note="Description of Artificial Sequence: Synthetic scFv sequence"
QVQLQESGGTLVQPGGSLRLSCAASGFTFSSYAMSWVRQAPGRGLEWVSTISGSGGSTYYADSVKGRFTISRDNSKNTLYLQMNSLRAEDTAVYYCAKGAYSGSHWGQGTLVTVSSGGGGSGGGGSGGGGSSSELTQDPAVSVALGQTVRITCQGDSLRSYYASWYQQKPGQAPSLVIYGENSRPSGIPDRFSGSSSGNTASLTITGAQAENEADYYCQAWDSSTAWFGGGTKLTVL

SEQ ID NO: 396 - protein, 235 aa, Artificial Sequence
  source: /note="Description of Artificial Sequence: Synthetic scFv sequence"
QVQLQESGGTLVQPGGSLRLSCAASGFTFSSYAMSWVRQAPGRGLEWVSTISGSGGSTYYADSVKGRFTISRDNSKNTLYLQMNSLRAEDTAVYYCAKGAYSGSYWGQGTLVTVSSGGGGSGGGGSGGGGSSSELTQDPAVSVALGQTVRITCQGDSLRSYYASWYQQKPGQAPSLVIYGENSRPSGIPDRFSGSSSGNTASLIGAQAENEADYYCQAWDSSTAWFGGGTKLTVL

SEQ ID NO: 397 - protein, 244 aa, Artificial Sequence
  source: /note="Description of Artificial Sequence: Synthetic scFv sequence"
QVQLVESGAEVKKPGASVKVSCKASGYTFTSYGISWVRQAPGQGLEWMGWISAYNGNTNYAQKLQGRVTMTTDTSTSTAYMELRSLRSDDTAVYYCARPIYDSSGYDAFDIWGQGTMVTVSSGGGGSGGGGSGGGGSDIVMTQSPSTLSASIGDRVTITCRASEGIYHWLAWYQQKPGKAPKLLIYKASSLASGAPSRFSGSGSGTDFTLTISSLQPDDFATYYCQQYHTISRTFGPGTKVDIK

SEQ ID NO: 398 - protein, 244 aa, Artificial Sequence
  source: /note="Description of Artificial Sequence: Synthetic scFv sequence"
QVQLVESGGGLVKPGGSLRLSCAASGFTFSSYAMHWVRQAPGKGLEWVAVISYDGSNKYYADSVKGRFTISRDNSKNTLYLQMNSLRAEDTAVYFCVRPSDSGWSFEHWGQGTLVPVSSGGGGSGGGGSGGGGSQSVLTQPPSASGTPGQRVTISCSGSSSNIGNNTVNWSRQLPGTAPKLLIYSNDQRPSGVPDRFSGSKSGTSASLAITGLQPEDEADYYCGTWDSSLSAYVFGTGTKLTVL

SEQ ID NO: 399 - protein, 237 aa, Artificial Sequence
  source: /note="Description of Artificial Sequence: Synthetic scFv sequence"
QVQLVESGGGLVQPGGSLRLSCAASGFTFSSYAMGWVRQAPGKGLEWVSAISGSGGSTYYADSVKGRFTISRDNSKDTLYLQMNSLRAEDTAVYYCASRSLLDYWGQGTLVTVSSGGGGSGGGGSGGGGSNFMLTQDPAVSVALGQTVRITCQGDSLRSYYASWYQQKPGQAPLLVIYGKNNRPSGIPDRFSGSSSGNTASLTITGAQAEDEADYYCNSRDSSGNPVFGGGTKVTVL

SEQ ID NO: 400 - protein, 245 aa, Artificial Sequence
  source: /note="Description of Artificial Sequence: Synthetic scFv sequence"
QVQLVESGGGLVQPGGSLRLSCAASGFTFSSYAMSWVHQAPGKGLEWVSAISGSGGSTYYADSVKGRFTISRDNSKNTLYLQMNSLRAEDTAVYYCAKTYYGFWSGYYDYLGQGTLVTVSSGGGGSGGGGSGGGGSSSELTQDPAVSVGLGQTVTITCQGDSLRSYYANWYQQKPGQAPILVIYGENNRPSGIPDRFSGSSSGNTASLTITGAQAEDEADYYCHSRDSSGTHLRVFGGGTKLTVL

SEQ ID NO: 401 - protein, 237 aa, Artificial Sequence
  source: /note="Description of Artificial Sequence: Synthetic scFv sequence"
QVQLVESGGGLVQPGGSLRLSCAASGFTFSSYAMSWVRQAPGKGLEWVSAISGSGGSTYYADSVKGRFTISRDNSKDTLYLQMNSLRAEDTAVYYCASRSLLDYWGQGTLVTVSSGGGGSGGGGSGGGGSNFMLTQDPAVSVALGQTVRITCQGDSLRSYYASWYQQKPGQAPLLVIYGKNNRPSGIPDRFSGSSSGNTASLTITGAQAEDEADYYCNSRDSSGNPVFGGGTKVTVL

SEQ ID NO: 402 - protein, 244 aa, Artificial Sequence
  source: /note="Description of Artificial Sequence: Synthetic scFv sequence"
QVQLVESGGGWQPGRSLRLSCAASGFTFSSFGMHWVRRAPGKGLEWVAVISYDGSNQYYADSVKGRFTISRDNSKNTLYLQMNSLRAEDTAVYYCGSRPGGGYASGSTVAYWGQGTPVTVSSGGGGSGGGGSGGGGSSSELTQDPAVSVALGQTVRITCQGDSLRSYYASWYQQKPGQAPLLVIYGQNIRPSGIPDRFSGSSSGNSASLTITGAQAEDEADYYCHSRDSSGKYVFGVGTKVTVL

SEQ ID NO: 403 - protein, 247 aa, Artificial Sequence
  source: /note="Description of Artificial Sequence: Synthetic scFv sequence"
QVQLVESGGGWQPGRSLRLSCTASGFTFSSYGMHWVRQAPGKGLEWVAVISYDGSNKYYADSVKGRFTISRDNSKNTLYLQMNSLRAEDTAVYYCARGGRYSSNWFSYYYYGMDVWGQGTTVTVSSGGGGSGGGGSGGGGSNFMLTQPPSVSVAPGKTARITCGGNNIGSKSVYWYQQKPGQAPVLWYDDSDRPSGIPERFSGSNSGNTATLTISRVEAGDEADYYCQVWDSSSDHWFGGGTKVTVL

SEQ ID NO: 404 - protein, 241 aa, Artificial Sequence
  source: /note="Description of Artificial Sequence: Synthetic scFv sequence"
QVQLVQSGGGVVQPGRSLRLSCAATGIPFSGSGMHWVRQAPGKGLEWVTMIWYDGSNKFYADSVKGRFTISRDNSKNTLYLQMDSLRAEDTAVYFCARDKGVRSMDVWGLGTTVTVSSGGGGSGGGGSGGGGSNFMLTQPPSVSVAPGQTAKITCDGYSIRTKSVHWYQQKPGQAPVVVVHDDSDRPSGIPERFSGSNSGTTATLTISRVEAGDEADYYCQAWDSISEEVVFGGGTKLTVL

SEQ ID NO: 405 - protein, 324 aa, Artificial Sequence
  source: /note="Description of Artificial Sequence: Synthetic scFv sequence"
MALPVTALLLPLALLLHAARPDIQVTQSPSSLSASLGERISLTCRTSQDISNYLNWFQQKPDGTFKRLIYATSSLDSGVPKRFSGSGSGSDYSLTISSLESEDFADYYCLQYASYPFTFGSGTKLEIKGGGGSGGGGSGGGGSEVQLQESGPGLVKPSQTLSLTCSVTGYSITSGYYWHWIRQFPGNKLQWMGYISYSGFTNYKTSLINRISITHDTSENQFFLNLNSVTTEDTATYYCAGDRTGSWFAYWGQGTLVTVSATTTPAPRPPTPAPTIASQPLSLRPEACRPAAGGAVHTRGDFACDIYIWAPLAGTLSLVITLYC

SEQ ID NO: 406 - protein, 252 aa, Artificial Sequence
  source: /note="Description of Artificial Sequence: Synthetic scFv sequence"
DIVLTQSPASLAVSLGQRATISCKASQSVDYDGDGYMDWYQQKPGQPPKLLIFAASNLKSGIPARFSGSGSGTDFTLNIHPVEEEDAATYYCQQTNEYPWTFGGGTKLEIKGSTSGSGKPGSGEGSTKGQIQLVQSGPELKKPGETVKISCKASGYTFTDYSMHWVKQAPGEGLKWMGWINTETGEPTYADDFKGRFAFSLETSASTAYLQINNLKNEDTATYFCYYGSYWGQGTLVTVSAGGGGSGGGGSC

SEQ ID NO: 407 - protein, 213 aa, Artificial Sequence
  source: /note="Description of Artificial Sequence: Synthetic scFv sequence"
DIQLTQSPSSLSASVGDRVTITCKASQDVGTSVAWYQQKPGKAPKLLIYWTSTRHTGVPSRFSGSGSGTDFTFTISSLQPEDIATYYCQQYSLYRSFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 408 - protein, 257 aa, Artificial Sequence
  source: /note="Description of Artificial Sequence: Synthetic scFv sequence"
MSVPTQVLGLLLLWLTGARCDIQMTQSPASLSASVGDTVTITCRASENIYSYLAWYQQKQGKSPQLLVYNAKALSEGVPSRFSGSGSGTQFSLRINSLQPEDFGDYYCQHHYNSPYTFGGGTKLEIKGSTSGSGKSSEGKGQIQLVQSGPELKKPGETVKISCKASGYSFTNDGINWVKQAPGKGFKYMGWINTITGEPTYTEDFKGRFAFSLETSASTAYLQINNLKDEDTATFFCAKGTGTSAYWGQGTLVTVSA

SEQ ID NO: 409 - protein, 256 aa, Artificial Sequence
  source: /note="Description of Artificial Sequence: Synthetic scFv sequence"
DILLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELKRGSTSGSGKPGSGEGSTKGQVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSAGGGGSGGGGSC

SEQ ID NO: 410 - protein, 234 aa, Artificial Sequence
  source: /note="Description of Artificial Sequence: Synthetic scFv sequence"
DIQMTQSPSSLSASVGDRVTITCKAGQNVGTSVAWFQQKPGKAPKSLIYSASYRYSGVPSRFSGSGSGTDFTLTISSLQPEDFATYYCQQYITYPYTFGGGTKVEIKGGGGSGGGGSGGGGSEVQLLESGGGLVQPGGSLRLSCAASGFTFSRYWMSWVRQAPGKGLEWVSEINPDSSTIQYTPSLKARFTISRDNSKNTLYLQMNSLRAEDTAVYYCTGPAYWGQGTLVTVSS

SEQ ID NO: 411 - protein, 249 aa, Artificial Sequence
  source: /note="Description of Artificial Sequence: Synthetic scFv sequence"
EIVLTQSPATLSLSPGERATLSCSVSSSISSSNLHWYQQKPGQAPRLLIYGTSNLASGIPARFSGSGSGTDFTLTISSLEPEDFAVYYCQQWSSYPHTFGGGTKVEIKGGGGSGGGGSGGGGSQVQLVQSGAEVKKPGASVKVSCKASGYTFTNYLIEWVRQAPGQGLEWMGLINPGSGGTNYNEKFKGRVTMTTDTSTSTAYMELRSLRSDDTAVYYCARRSPLGSWIYYAYDGVAYWGQGTLVTVSS

SEQ ID NO: 412 - protein, 480 aa, Artificial Sequence
  source: /note="Description of Artificial Sequence: Synthetic scFv sequence"
MALPVTALLLPLALLLHAARPDIQMTQSPSSLSASVGDRVTITCKAGQNVGTSVAWFQQKPGKAPKSLIYSASYRYSGVPSRFSGSGSGTDFTLTISSLQPEDFATYYCQQYITYPYTFGGGTKVEIKGGGGSGGGGSGGGGSEVQLLESGGGLVQPGGSLRLSCAASGFTFSRYWMSWVRQAPGKGLEWVSEINPDSSTIQYTPSLKARFTISRDNSKNTLYLQMNSLRAEDTAVYYCTGPAYWGQGTLVTVSSSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 413 - protein, 493 aa, Artificial Sequence
  source: /note="Description of Artificial Sequence: Synthetic scFv sequence"
MALPVTALLLPLALLLHAARPEIVLTQSPATLSLSPGERATLSCSVSSSISSSNLHWYQQKPGQAPRLLIYGTSNLASGIPARFSGSGSGTDFTLTISSLEPEDFAVYYCQQWSSYPHTFGGGTKVEIKGGGGSGGGGSGGGGSQVQLVQSGAEVKKPGASVKVSCKASGYTFTNYLIEWVRQAPGQGLEWMGLINPGSGGTNYNEKFKGRVTMTTDTSTSTAYMELRSLRSDDTAVYYCARRSPLGSWIYYAYDGVAYWGQGTLVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 414 - protein, 242 aa, Artificial Sequence
  source: /note="Description of Artificial Sequence: Synthetic scFv sequence"
SQVQLQQPGAELVRPGASVKLSCKASGYSFTTYWMNWVKQRPGQGLEWIGMIHPSDSETRLNQKFKDKATLTVDKSSSTAYMQLSSPTSEDSAVYYCARSTMIATRAMDYWGQGTSVTVSGGGGSGGGGSGGGGSDIVMTQSQKSMSTSVGDRVSITCKASQDVITGVAWYQQKPGQSPKLLIYSASYRYTGVPDRFTGSGSGTDFTFTISNVQAEDLAVYYCQQHYSTPLTFGAGTKLELK

SEQ ID NO: 415 - protein, 244 aa, Artificial Sequence
  source: /note="Description of Artificial Sequence: Synthetic scFv sequence"
EVQLQQSGPELVKPGASMKISCKASGYSFTGYTMNWVKQSHGKNLEWIGLINPYNGGTIYNQKFKGKATLTVDKSSSTAYMELLSLTSEDSAVYYCARDYGFVLDYWGQGTTLTVSSGGGGSGGGGSGGGGSGGGGSQIVLTQSPSIMSVSPGEKVTITCSASSSVSYMHWFQQKPGTSPKLCIYSTSNLASGVPARFSGRGSGTSYSLTISRVAAEDAATYYCQQRSNYPPWTFGGGTKLEIK

SEQ ID NO: 416 - protein, 244 aa, Artificial Sequence
  source: /note="Description of Artificial Sequence: Synthetic scFv sequence"
EVQLQQSGPELVKPGASMKISCKASGYSFTGYTMNWVKQSHGKNLEWIGLINPYNGGTIYNQKFKGKATLTVDKSSSTAYMELLSLTSEDSAVYYCARDYGFVLDYWGQGTTLTVSSGGGGSGGGGSGGGGSGGGGSQIVLTQSPAIMSASPGEKVTITCSASSSVSYLHWFQQKPGTSPKLWVYSTSNLPSGVPARFGGSGSGTSYSLTISRMEAEDAATYYCQQRSIYPPWTFGGGTKLEIK

SEQ ID NO: 417 - protein, 244 aa, Artificial Sequence
  source: /note="Description of Artificial Sequence: Synthetic scFv sequence"
EVQLQQSGPELVKPGASMKISCKASGYSFTGYTMNWVKQSHGKNLEWIGLINPYNGGTIYNQKFKGKATLTVDKSSSTAYMELLSLTSEDSAVYYCARDYGFVLDYWGQGTTLTVSSGGGGSGGGGSGGGGSGGGGSQIVLTQSPSIMSVSPGEKVTITCSASSSVSYMHWFQQKPGTSPKLGIYSTSNLASGVPARFSGRGSGTSYSLTISRVAAEDAATYYCQQRSNYPPWTFGGGTKLEIK

SEQ ID NO: 418 - protein, 239 aa, Artificial Sequence
  source: /note="Description of Artificial Sequence: Synthetic scFv sequence"
EVQLQQSGPELVKPGASMKISCKASGYSFTGYTMNWVKQSHGKNLEWIGLINPYNGGTIYNQKFKGKATLTVDKSSSTAYMELLSLTSEDSAVYYCARDYGFVLDYWGQGTTLTVSSGGGGSGGGGSGGGGSQIVLTQSPSIMSVSPGEKVTITCSASSSVSYMHWFQQKPGTSPKLCIYSTSNLASGVPARFSGRGSGTSYSLTISRVAAEDAATYYCQQRSNYPPWTFGGGTKLEIK

SEQ ID NO: 419 - protein, 241 aa, Artificial Sequence
  source: /note="Description of Artificial Sequence: Synthetic scFv sequence"
DIQMTQSPASLSASVGETVTITCRASENIDSYLAWYQQKQGKSPQLLVYASTLLVDGVPSRFSGSRSGTQFSLKINSLQSEDVARYYCQHYYSIPYTFGSGTKLEIKGGGGSGGGGSGGGGSEVKLVESGGGLVKPGGSLKLSCAASGFTFNSYTMSWVRQTPAKRLEWVVTISSGGGRTYYPDSVKGRFTISRDNARNTLYLQMSSLRSEDTAMYYCIRGDYRYDGFAYWGQGTVVTVST

SEQ ID NO: 420 - protein, 241 aa, Artificial Sequence
  source: /note="Description of Artificial Sequence: Synthetic scFv sequence"
EVKLVESGGGLVKPGGSLKLSCAASGFTFNSYTMSWVRQTPAKRLEWVVTISSGGGRTYYPDSVKGRFTISRDNARNTLYLQMSSLRSEDTAMYYCIRGDYRYDGFAYWGQGTVVTVSTGGGGSGGGGSGGGGSDIQMTQSPASLSASVGETVTITCRASENIDSYLAWYQQKQGKSPQLLVYASTLLVDGVPSRFSGSRSGTQFSLKINSLQSEDVARYYCQHYYSIPYTFGSGTKLEIK

SEQ ID NO: 421 - protein, 247 aa, Artificial Sequence
  source: /note="Description of Artificial Sequence: Synthetic scFv sequence"
EVQLQQSGAEVKKPGSSVKVSCKASGGTFSSYAISWVRQAPGQGLEWMGGIIPIFGTANYAQKFQGRVTITADESTSTAYMELSSLRSEDTAVYYCARDLEMATIMGGYWGQGTLVTVSSGGGGSGGGGSGGGGSQSALTQPASVSGSPGQSITISCTGTSSDVGGYNYVSWYQQHPGKAPKLMIYDVSNRPSGVSNRFSGSKSGNTASLTISGLQAEDEADYYCSSYTSSSTLDVVFGGGTKLTVL

SEQ ID NO: 422 - protein, 245 aa, Artificial Sequence
  source: /note="Description of Artificial Sequence: Synthetic scFv sequence"
EVQLQQSGPGLVRPSETLSLTCTVSGGPVRSGSHYWNWIRQPPGRGLEWIGYIYYSGSTNYNPSLENRVTISIDTSNNHFSLKLSSVTAADTALYFCARGTATFDWNFPFDSWGQGTLVTVSSGGGGSGGGGSGSGGSDIQMTQSPSSLSASIGDRVTITCRASQSISSYLNWYQQKPGKAPKLLIYAASSLQSGVPSRFSGSGSGTDFTLTISSLQPEDFATYYCQQSYSTPWTFGQGTKLEIK

SEQ ID NO: 423 - protein, 255 aa, Artificial Sequence
  source: /note="Description of Artificial Sequence: Synthetic scFv sequence"
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARDPSSSGSYYMEDSYYYGMDVWGQGTTVTVSSGGGGSGGGGSGGGGSNFMLTQPHSVSESFGKTVTISCTGSSGSIASNYVQWYQQRPGSAPTTVIYEDNQRPSGVPDRFSGSIDSSSNSASLTISGLKTEDEADYYCQSYDSSNQVVFGGGTKLTVL

SEQ ID NO: 424 - protein, 255 aa, Artificial Sequence
  source: /note="Description of Artificial Sequence: Synthetic scFv sequence"
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARDPSSSGSYYMEDSYYYGMDVWGQGTTVTVSSGGGGSGGGGSGGGGSNFMLTQPHSVSESPGKTVTISCTGSSGSIASNYVQWYQQRPGSAPTTVIYEDNQRPSGVPDRFSGSIDSSSNSASLTISGLKTEDEADYYCQSYDSSNQVVFGGGTKLTVL

SEQ ID NO: 425 - protein, 245 aa, Artificial Sequence
  source: /note="Description of Artificial Sequence: Synthetic scFv sequence"
EVQLVESGGGLVQPGGSLRLSCAASGFTFSSYEMNWVRQAPGKGLEWVSYISSSGSTIYYADSVKGRFTISRDNAKNSLYLQMNSLRAEDTAVYYCARDPYSSSWHDAFDIWGQGTMVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVDIK

SEQ ID NO: 426 - protein, 245 aa, Artificial Sequence
  source: /note="Description of Artificial Sequence: Synthetic scFv sequence"
EVQLVESGGGVVQPGGSLRLSCAASGFTFDDYAMHWVRQAPGKGLEWVSLISGDGGSTYYADSVKGRFTISRDNSKNTLYLQMNSLRVEDTAVYYCARVFDSYYMDVWGKGTTVTVSSGGGGSGGGGSGSGGSEIVLTQSPLSLPVTPGQPASISCRSSQSLVYTDGNTYLNWFQQRPGQSPRRLIYKVSNRDSGVPDRFSGSGSDTDFTLKISRVEAEDVGIYYCMQGTHWSFTFGQGTRLEIK

SEQ ID NO: 427 - protein, 245 aa, Artificial Sequence
  source: /note="Description of Artificial Sequence: Synthetic scFv sequence"
EVQLVESGGGVVQPGGSLRLSCAASGFTFDDYAMHWVRQAPGKGLEWVSLISGDGGSTYYADSVKGRFTISRDNSKNTLYLQMNSLRVEDTAVYYCARVFDSYYMDVWGKGTTVTVSSGGGGSGGGGSGSGGSEIVLTQSPLSLPVTPGQPASISCRSSQSLVYTDGNTYLNWFQQRPGQSPRRLIYKVSNRDSGVPDRFSGSGSDTDFTLKISRVEAEEVGIYYCMQGTHWSFTFGQGTRLEIK

SEQ ID NO: 428 - protein, 246 aa, Artificial Sequence
  source: /note="Description of Artificial Sequence: Synthetic scFv sequence"
EVQLVQSGGGVVRSGRSLRLSCAASGFTFNSYGLHWVRQAPGKGLEWVALIEYDGSNKYYGDSVKGRFTISRDKSKSTLYLQMDNLRAEDTAVYYCAREGNEDLAFDIWGQGTLVTVSSGGGGSGGGGSGGGGSGGGGSEIVLTQSPSSLSASVGDRVTITCQASQFIKKNLNWYQHKPGKAPKLLIYDASSLQTGVPSRFSGNRSGTTFSFTISSLQPEDVATYYCQQHDNLPLTFGGGTKVEIK

SEQ ID NO: 429 - protein, 239 aa, Artificial Sequence
  source: /note="Description of Artificial Sequence: Synthetic scFv sequence"
QVNLRESGGGLVQPGGSLRLSCAASGFTFSSYEMNWVRQAPGKGLEWVSYISSSGSTIYYADSVKGRFTISRDNAKNSLYLQMNSLRAEDTAVYYCAREALGSSWEWGQGTTVTVSSGGGGSGGGGSGGGGSDIQMTQSPSSLSASVGDRVTITCQASQDISNYLNWYQQKPGKAPKLLIYDASNLETGVPSRFSGSGSGTDFTFTISSLQPEDIATYYCQQYDNLPLTFGGGTKLEIK

SEQ ID NO: 430 - protein, 249 aa, Artificial Sequence
  source: /note="Description of Artificial Sequence: Synthetic scFv sequence"
QVQLQESGAGLLKPSETLSLTCAVYGGSFSGYYWSWIRQPPGKGLEWVGEINHSGSTNYNPSLKSRVTISVDTSKNQFSLKLSSVTAADTAVYYCARGSGLVVYAIRVGSGWFDYWGQGTLVTVSSGGGGSGGGDSGGGGSDIQMTQSPSSLSASVGDRVTITCRASQSISSYLNWYQQKPGKAPKLLMYAASSLQSGVPSRFSGSGSGTDFTLTISSLQPEDFATYYCQQSYSTPPWTFGQGTKVDIK

SEQ ID NO: 431 - protein, 247 aa, Artificial Sequence
  source: /note="Description of Artificial Sequence: Synthetic scFv sequence"
QVQLQESGPGLVKPSETLSLTCTVSGGSISSSSYYWGWIRQPPGKGLEWIGSIYYSGSTYYNPSLKSRVSISVDTSKNQFSLKLKYVTAADTAVYYCATPGTYYDFLSGYYPFYWGQGTLVTVSSGGGGSGGGGSGGGGSDIVMTQSPSSLSASVGDRVTITCRASQGISSYLAWYQQKPGKAPKLLIYAASTLQSGVPSRFSGSGSGTDFTLTISSLQPEDFATYYCQQLNSYPYTFGQGTKLEIK

SEQ ID NO: 432 - protein, 255 aa, Artificial Sequence
  source: /note="Description of Artificial Sequence: Synthetic scFv sequence"
QVQLVESGGGLVQPGGSLRLSCAASGFNVSSNYMTWVRQAPGKGLEWVSVIYSGGATYYGDSVKGRFTVSRDNSKNTVYLQMNRLTAEDTAVYYCARDRLYCGNNCYLYYYYGMDVWGQGTLVTVSSGGGGSGGGGSGGGGSGGGGSDIQVTQSPSSLSASVGDRVTITCRASQSISSYLNWYQQKPGKAPKLLIYAASSLQSGVPSRFSGSGSGTDFTLTISSLQPEDFATYYCQQSYSTPPLTFGQGTKVEIK

SEQ ID NO: 433 - protein, 239 aa, Artificial Sequence
  source: /note="Description of Artificial Sequence: Synthetic scFv sequence"
QVQLVESGGGLVQPGGSLRLSCAASGFTFSSYWMSWVRQAPGKGLEWVANINEDGSAKFYVDSVKGRFTISRDNAKNSLYLQMNSLRAEDTAVYFCARDLRSGRYWGQGTLVTVSSGGGGSGGGGSGGGGSEIVLTQSPGTLSLSPGGRATLSCRASQSISGSFLAWYQQKPGQAPRLLIYGASSRATGIPDRFSGSGSGTDFTLTISRLEPEDFAVYYCQQYGSSPPTFGLGTKLEIK

SEQ ID NO: 434 - protein, 246 aa, Artificial Sequence
  source: /note="Description of Artificial Sequence: Synthetic scFv sequence"
QVQLVQSGAEVKEPGASVKVSCKAPANTFSDHVMHWVRQAPGQRFEWMGYIHAANGGTHYSQKFQDRVTITRDTSANTVYMDLSSLRSEDTAVYYCARGGYNSDAFDIWGQGTMVTVSSGGGGSGGGGSGGGGSGGGGSDIVMTQSPSSVSASVGDRVTITCRASQDISSWLAWYQQKPGKAPKLLIYAASSLQSGVPSRFNGSGSGTDFTLTISSLQPEDFATYYCQQSYSTPLTFGGGTKVEIK

SEQ ID NO: 435 - protein, 247 aa, Artificial Sequence
  source: /note="Description of Artificial Sequence: Synthetic scFv sequence"
QVQLVQSGAEVKKSGASVKVSCKASGYPFTGYYIQWVRQAPGQGLEWMGWIDPNSGNTGYAQKFQGRVTMTRNTSISTAYMELSSLRSEDTAVYYCASDSYGYYYGMDVWGQGTLVTVSSGGGGSGGGGSGGGGSGGGGSDIQMTQSPSSLSASVGDRVTFTCRASQGISSALAWYQQKPGKPPKLLIYDASSLESGVPSRFSGSGSGTDFTLTISSLQFEDFATYYCQQFNNYPLTFGGGTKVEIK

SEQ ID NO: 436 - protein, 247 aa, Artificial Sequence
  source: /note="Description of Artificial Sequence: Synthetic scFv sequence"
QVQLVQSGAEVKKSGASVKVSCKASGYPFTGYYIQWVRQAPGQGLEWMGWIDPNSGNTGYAQKFQGRVTMTRNTSISTAYMELSSLRSEDTAVYYCASDSYGYYYGMDVWGQGTLVTVSSGGGGSGGGGSGGGGSGGGGSDIQMTQSPSSLSASVGDRVTFTCRASQGISSALAWYQQKPGKPPKLLIYDASSLESGVPSRFSGSGSGTDFTLTISSLQPEDFATYYCQQFNNYPLTFGGGTKVEIK

SEQ ID NO: 437 - protein, 248 aa, Artificial Sequence
  source: /note="Description of Artificial Sequence: Synthetic scFv sequence"
QVQLVQSGGGLVQPGGSLRLSCAASGFTFSSYSMNWVRQAPGKGLEWVSYISSSSSTIYYADSVKGRFTISRDNAKNSLYLQMNSLRAEDTAVYYCARDLSVRAIDAFDIWGQGTMVTVSSGGGGSGGGGSGGGGSGGGGSDIVLTQSPSSLSASVGDRVTITCQASQDISNYLNWYQQKPGKAPKLLIYDASNLETGVPSRFSGSGSGTDFTFTISSLQPEDFATYYCQQAYSTPFTFGPGTKVEIK

SEQ ID NO: 438 - protein, 253 aa, Artificial Sequence
  source: /note="Description of Artificial Sequence: Synthetic scFv sequence"
EVQLVESGGGLVQPGRSLRLSCAASGFTFDDYDMHWVRQAPGKGLEWVSSISWSGGTIGYADSVKGRFTVSRDNAKNSLYLQMNSVRAEDTALYYCAKDRGAVAALPDYQYGMDVWGRGTLVTVSSGGGGSGGGGSGGGGSAQSALTQPASVSGSPGQSITISCTGTSSDIGSYNLVSWYQQHPGKAPKLMIYEDYKRASGVSNHFSGSKSGNTASLTISGLQAEDEADYYCSSYAGSSAWVFGGGTKVTVLG

SEQ ID NO: 439 - protein, 248 aa, Artificial Sequence
  source: /note="Description of Artificial Sequence: Synthetic scFv sequence"
EVQLVESGPGLVKPSGTLSLTCAVSGGSISTSDWWSWVRRPPGKGLEWIGEIYHSGSTNYHPSLKSRVTISLDKSKNQFSLKLSSVTAADTAVYYCAREGGHSGSYPLDYWGRGTLVTVSSGGGGSGGGGSGGGGSAQSVVTQPPSVSAAPGQKVTISCSGNFSNIEYNYVSWYQHLPGTAPKLLIFDNNQRPSWIPDRFSGSKSGTSATLGITGLQTGDEADYYCGTWDSSLNAGVFGGGTKVTVLG

SEQ ID NO: 440 - protein, 255 aa, Artificial Sequence
  source: /note="Description of Artificial Sequence: Synthetic scFv sequence"
EVQLVQSGAEMKKPGSSVKVSCKASGGTFSSYAVNWVRQAPGQGLEWMGGIIPIFDTSNYAQKFQGRLTMTADDSTNTAYMELRSLRSEDTAVYYCARGAPRGTVMAFSSYYFDLWGQGTLVTVSSGGGGSGGGGSGGGGSALNFMLTQPHSVSESPGKTVIISCAGSGGNIATNYVQWYQHRPGSAPITVIYEDNQRPSGVPDRFSGSVDSSSNSASLTISGLQTEDEADYYCHSYDNTDQGVFGTGTKVTVLG

SEQ ID NO: 441 - protein, 257 aa, Artificial Sequence
  source: /note="Description of Artificial Sequence: Synthetic scFv sequence"
EVQLVQSGAEVKKPGASVKVSCKASGYSFPSSGLSWVRQAPGQGPEWMGWIGIYNGNTDYAQKFQGRVTMTTDKSTSTAYMELRSLRSDDTAVYYCARDSVGSISVAGTMQYYYFAMDVWGQGTLVTVSSGGGGSGGGGSGGGGSAQSVLTQPPSASGSPGQSVTISCAGTRYDIGTYNYVSWYQQHPAKGPKLIIYAVSERPSGVPNRFSGSKSGNTASLTVSGLRAEDEAHYYCSSYAGNNNVIFGGGTKVTVLG

SEQ ID NO: 442 - protein, 248 aa, Artificial Sequence
  source: /note="Description of Artificial Sequence: Synthetic scFv sequence"
EVQLVQSGAEVKKPGASVKVSCKVSGYSLSELSMHWVRQAPGKGLEWMGGFDPQNGYTIYAQEFQGRITMTEDTSTDTVYMELGSLRSEDTAVYFCAAIEITGVNWYFDLWGKGTLVTVSSGGGGSGGGGSGGGGSALSSELTQDPDVSVALGQTVRITCQGDSLKKFYPGWYQQKPGQAPLLVLYGENIRPSRIPDRFSGSSSGNTATLTITGAQAEDEAVYYCNSREASVHHVRVFGGGTKLTVLG

SEQ ID NO: 443 - protein, 250 aa, Artificial Sequence
  source: /note="Description of Artificial Sequence: Synthetic scFv sequence"
EVQLVQSGAEVKKPGATLKVSCKVSAYTFTDYSMHWVQQAPGKGLKWMGLIDLEDGNTIYAEEFQDRVTITADTSTDTAYMDLSSLRSEDTAVFYCAISPLRGLTADVFDVWGQGTLVTVSSGGGGSGGGGSGGGGSAQSALTQPASASGSPGQSITISCTGTSSDIGRYDFVSWYQRQPGKAPKLMIYDVINRPSGVSSRFSGSKSGNTASLTISGLQAEDEADYYCSSYAGSTTLYVFGTGTKLTVLG

SEQ ID NO: 444 - protein, 246 aa, Artificial Sequence
  source: /note="Description of Artificial Sequence: Synthetic scFv sequence"
EVQLVQSGAEVKKPGSSVKVSCKASGGSFSNYDFSWVRQAPGQGLEWMGEIINAFGSSRYAQKFQDRVTITADESASTAYMELRGLTSEDTATYYCARAERWELNMAFDMWGRGTLVTVSSGGGGSGGGGSGGGGSAQSVLTQPPSVSVAPGQTARITCGGDNIGRKNVHWYQQRPGLAPVLVVYDDTDRPSGIPERFSGSNSGDTATLTITWVEAGDEADYYCQLWDSDTYDVLFGGGTKLTVLG

SEQ ID NO: 445 - protein, 251 aa, Artificial Sequence
  source: /note="Description of Artificial Sequence: Synthetic scFv sequence"
EVQLVQSGAEVKKPGSSVKVSCKASGGTFKTYAINWVRQAPGQGLEWMGGIIPVLGTANYVQKFQGRVTITADESTTTAYMELRGLRSEDTAVYYCARGEGSGWYDHYYGLDVWGQGTLVTVSSGGGGSGGGGSGGGGSAQSVLTQPPSASGTPGQRVTISCSGSSSNIGSNTVNWYRQLPGTAPKLLIFGDDQRPSGVPDRFSGSRSGTSVSLAISGLQSEDEADYYCAAWDDSLNGGVFGGGTKLTVLG

SEQ ID NO: 446 - protein, 247 aa, Artificial Sequence
  source: /note="Description of Artificial Sequence: Synthetic scFv sequence"
EVQLVQSGAEVKKPGSSVKVSCKSSGGPFSSYGISWVRQAPGQGLEWMGGISPIFGTANYAQKFQGRVTITADESTETAYMELSSLRSEDTAVYYCARDESPVGFYALDIWGRGTTVTVSSGGGGSGGGGSGGGGSALSYELTQPPSVSVAPGQTARINCGGDKIGSRSVHWYQQKPGQAPVMVVYDDSDRPSGIPERFSGSNSGNTATLTISSVEAGDEADYYCQVWDGSTDPWVFGGGTKVTVLG

SEQ ID NO: 447 - protein, 249 aa, Artificial Sequence
  source: /note="Description of Artificial Sequence: Synthetic scFv sequence"
EVQLVQSGAEVKKPGSSVKVSCQASGGTFTSHAMYWVRQAPGQGLEWMGGIIPIFGRTNYAQKFQGRVTFTADMSTSTAYMEMTSLRSDDTAVYYCARGDNWNDLYPIDYWGRGTLVTVSSGGGGSGGGGSGGGGSALNFMLTQPHSVSESPGKTVTISCTRSSGSIATTYVQWFQQRPGSSPTTVIYDDDQRPSGVPDRFSGSIDSSSNSASLTISGLMPEDEADYYCQSYDNTDLVFGGGTQLTVLS

SEQ ID NO: 448 - protein, 245 aa, Artificial Sequence
  source: /note="Description of Artificial Sequence: Synthetic scFv sequence"
EVQLVQSGAEVRKPGSSMKVSCKASGDTFRNFAFSWVRQAPGQGLEWMGGVIPLVGPPKYAQKFQGRLTITADESTSTSYMDLTSLTLEDTAVYFCARGGVYAPFDKWGQGTLVTVSSGGGGSGGGGSGGGGSAQSVVTQPPSVSEAPRQRVTISCSGSSSNIGNNAVNWYQQLPGKAPKLLIYYNDLLPSGVSDRFSGSKSGTSASLAISGLQSEDEADYYCAAWDDSLNGWVFGGGTKVTVLG

SEQ ID NO: 449 - protein, 240 aa, Artificial Sequence
  source: /note="Description of Artificial Sequence: Synthetic scFv sequence"
GVQLVESGGGLVKPGGSLRLSCAASGFTFSSYTMNWVRQAPGKGLEWVSYISSSGSATYYADSVKGRFTISRDNANNSLYLQMNSLRAEDTAVYYCARGYRYGMDVWGQGTLVTVSSGGGGSGGGGSGGGGSGIVMTQSPSTLSASVGDRVTITCRASQGISSWLAWYQQKPGRAPKVLIYKASTLESGVPSRFSGSGSGTDFTLTISSLQPEDFATYYCQQSYSTPWTFGQGTKLEIKR

SEQ ID NO: 450 - protein, 242 aa, Artificial Sequence
  source: /note="Description of Artificial Sequence: Synthetic scFv sequence"
KVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKDDVRNAFDIWGRGTTVTVSSGGGGSGGGGSGGGGSAQSVLTQPPSVSVSPGQTTSITCSRDKLGEQYVYWYQQRPGQSPILLLYQDSRRPSWIPERFSGSNSGDTATLTISGTQALDEADYYCQAWDNSSYVAFGGGTKVTVLG

SEQ ID NO: 451 - protein, 240 aa, Artificial Sequence
  source: /note="Description of Artificial Sequence: Synthetic scFv sequence"
QLQLQESGPGLVKPSGTLSLTCAVSGDSVSSYYWWSWVRQPPGKGLEWIGEIFRDGSSNYNRSLKSRVTISPDKPKNQFSLRLSSVTAADTAIYYCARHIRGYDAFDIWGRGTLVTVSSGGGGSGGGGSGGGGSAQSVLTQPPSVSGAPGQRVTISCTGSSSNIGAGYDVHWYQQFPGRAPKLLIYGNTNRPSGVPDRFSGSKSDISASLAITGLQAEDEADYYCQSYDSNLTGVFGGGT

SEQ ID NO: 452 - protein, 250 aa, Artificial Sequence
  source: /note="Description of Artificial Sequence: Synthetic scFv sequence"
QLQLQESGPGLVKPSGTLSLTCAVSGGSISSTNWWSWVRQPPGKGLEWIGEIYHSGSTNYNPSLKSRVTISVDKSKNHFSLNLSSVTAADTAVYYCARDSMGSTGWHYGMDLWGKGTLVTVSSGGGGSGGGGSGGGGSAQSALTQPASVSGSPGQSIAISCTGTSSDVGGYNYVSWYQQHPGKAPKLMIYAVTNRPSGVSDRFSGSKSGNTASLTISGLQADDEADYYCSSYTSSSSLVFGGGTKLTVLG

SEQ ID NO: 453 - protein, 250 aa, Artificial Sequence
  source: /note="Description of Artificial Sequence: Synthetic scFv sequence"
QLQLQESGPGLVKPSGTLSLTCAVSGGSISSTNWWSWVRQPPGKGLEWIGEIYHSGSTNYNPSLKSRVTISVDKSKNHFSLNLSSVTAADTAVYYCARDSMGSTGWHYGMDLWGRGTLVTVSSGGGGSGGGGSGGGGSAQSALTQPPSASGSPGQSVTISCSGSSSDIGDYNHVSWYQQHPGKAPKLMIYDVNKWPSGVPDRFSGSKSGNTASLTVSGLQAEDEADYYCSSYSGIYNLVFGGGTKVTVLG

SEQ ID NO: 454 - protein, 251 aa, Artificial Sequence
  source: /note="Description of Artificial Sequence: Synthetic scFv sequence"
QLQLQESGPGLVKPSGTLSLTCAVSGGSISTSDWWSWVRRPPGKGLEWIGEIYHSGSTNYHPSLKSRVTISLDKSKNQFSLKLSSVTAADTAVYYCAREGGHSGSYPLDYWGKGTLVTVSSGGGGSGGGGSGGGGSALNFMLTQPHSVSESPGKTVTISCTRSSGSIASNYVQWYQQRPGSSPTTVIYEDNQRPSGVPDRFSGSIDSSSNSASLTISGLKTEDEADYYCQSYDSSNPYVVFGGGTKLTVLG

SEQ ID NO: 455 - protein, 248 aa, Artificial Sequence
  source: /note="Description of Artificial Sequence: Synthetic scFv sequence"
QLQLQESGPGLVKPSGTLSLTCAVSGGSISTSDWWSWVRRPPGKGLEWIGEIYHSGSTNYHPSLKSRVTISLDKSKNQFSLKLSSVTAADTAVYYCAREGGHSGSYPLDYWGKGTLVTVSSGGGGSGGGGSGGGGSAQAVLTQPSSVSAAPGQKVTISCSGSSSNIGNNYVSWYQQLPGTAPKLLIYDNNKRPSGIPDRFSGSRSGTSATLGITGLQTGDEADYYCGTWDSSLSAVVFGTGTKLTVLG

SEQ ID NO: 456 - protein, 251 aa, Artificial Sequence
  source: /note="Description of Artificial Sequence: Synthetic scFv sequence"
QLQLQESGPGLVKPSGTLSLTCAVSGGSISTSDWWSWVRRPPGKGLEWIGEIYHSGSTNYHPSLKSRVTISLDKSKNQFSLKLSSVTAADTAVYYCAREGGHSGSYPLDYWGQGTLVTVSSGGGGSGGGGSGGGGSALNFMLTQPHSVSESPGKTVTISCTGSSGSIASNYVQWYQQRPGSAPTTLIYEDDQRPSGVPDRFSGSVDSSSNSASLTISGLKTEDEADYYCQSYDRSNQAVVFGGGTKLTVLG

SEQ ID NO: 457 - protein, 251 aa, Artificial Sequence
  source: /note="Description of Artificial Sequence: Synthetic scFv sequence"
QLQLQESGPGLVKPSGTLSLTCAVSGGSISTSDWWSWVRRPPGKGLEWIGEIYHSGSTNYHPSLKSRVTISLDKSKNQFSLKLSSVTAADTAVYYCAREGGHSGSYPLDYWGQGTLVTVSSGGGGSGGGGSGGGGSALNFMLTQPHSVSESPGKTVTISCTRSSGSIDNNYVQWYQQRPGSSPTTVIFEDNQRPSGVPDRFSGSIDSSSNSASLTISGLKTEDEADYYCQSYDSHNQGVVFGGGTKLTVLG

SEQ ID NO: 458 - protein, 249 aa, Artificial Sequence
  source: /note="Description of Artificial Sequence: Synthetic scFv sequence"
QLQLQESGPGLVKPSGTLSLTCAVSGGSISTSDWWSWVRRPPGKGLEWIGEIYHSGSTNYHPSLKSRVTISLDKSKNQFSLKLSSVTAADTAVYYCAREGGHSGSYPLDYWGQGTLVTVSSGGGGSGGGGSGGGGSALNFMLTQPHSVSESPGKTVTVSCTGSGGNIASNYVQWYQQRPDSAPTLVIFEDTQRPSGVPARFSGSIDSSSNSASLIISSLRTEDEADYYCQSSDSNRVVFGGGTKVTVLG

SEQ ID NO: 459 - protein, 248 aa, Artificial Sequence
  source: /note="Description of Artificial Sequence: Synthetic scFv sequence"
QLQLQESGPGLVKPSGTLSLTCAVSGGSISTSDWWSWVRRPPGKGLEWIGEIYHSGSTNYHPSLKSRVTISLDKSKNQFSLKLSSVTAADTAVYYCAREGGHSGSYPLDYWGQGTLVTVSSGGGGSGGGGSGGGGSAQSVVTQPPSVSAAPGQKVTISCSGSSSNIGNNYVSWYKQLPGTAPKLLIYDNNKRPSGIPDRFSGSKSGTSATLGITGLQTGDEADYYCGTWDSSLSGVVFGGGTKLTVLG

SEQ ID NO: 460 - protein, 250 aa, Artificial Sequence
  source: /note="Description of Artificial Sequence: Synthetic scFv sequence"
QLQLQESGPGLVKPSGTLSLTCAVSGGSISTSDWWSWVRRPPGKGLEWIGEIYHSGSTNYHPSLKSRVTISLDKSKNQFSLKLSSVTAADTAVYYCAREGGHSGSYPLDYWGRGTLVTVSSGGGGSGGGGSGGGGSALNFMLTQPHSVSESPGKTVTISCARSSGSIASNYVQWYQQRPGSSPTTLIYEDRQRPSGVPDRFSGSIDSSSNSASLTISGLKTEDEADYYCQSYDSSDHVVFGGGTKLTVLG

SEQ ID NO: 461 - protein, 251 aa, Artificial Sequence
  source: /note="Description of Artificial Sequence: Synthetic scFv sequence"
QLQLQESGPGLVKPSGTLSLTCAVSGGSISTSDWWSWVRRPPGKGLEWIGEIYHSGSTNYHPSLKSRVTISLDKSKNQFSLKLSSVTAADTAVYYCAREGGHSGSYPLDYWGRGTLVTVSSGGGGSGGGGSGGGGSALNFMLTQPHSVSESPGKTVTISCTRSSGSIASNYVQWYQQRPGSSPTTLIYDDNQRPSGVPDRFSGSIDSSSNSASLTISGLKTEDEADYYCQSYDSSNLGVVFGGGTKLTVLG

SEQ ID NO: 462 - protein, 248 aa, Artificial Sequence
  source: /note="Description of Artificial Sequence: Synthetic scFv sequence"
QLQLQESGPGLVKPSGTLSLTCAVSGGSISTSDWWSWVRRPPGKGLEWIGEIYHSGSTNYHPSLKSRVTISLDKSKNQFSLKLSSVTAADTAVYYCAREGGHSGSYPLDYWGRGTLVTVSSGGGGSGGGGSGGGGSAQSVLTQPPSVSAAPGQKVTISCSGSSSNIGNSYVSWYKQLPGTAPKVLIYDNQKRSSGIPDRFSASKSGTSATLGITGLRTEDEADYYCGTWDTSLSAVVFGGGTKLTVLG

SEQ ID NO: 463 - protein, 252 aa, Artificial Sequence
  source: /note="Description of Artificial Sequence: Synthetic scFv sequence"
QVQLQESGAEVKKPGSSVKVSCKASGGTFSSSAISWVRQAPGQGLEWMGGIIPVFGTANYAQKFQDRVTITADESTSTAYLELSRLTSEDTAVYYCASRGEYDYGDYDVYYYYMEVWGQGTLVTVSSGGGGSGGGGSGGGGSAQSVLTQPPSVSVAPGQTARLTCGANNIGSTSVHWYQQKPGQAPVLVIYDDTDRPSGIPERFSGSNSGNTATLTIRRVEAGDEADYYCQVWDTNSDHVIFGGGTKLTVLG

SEQ ID NO: 464 - protein, 243 aa, Artificial Sequence
  source: /note="Description of Artificial Sequence: Synthetic scFv sequence"
QVQLQESGGGLLQPGGSLRLSCAASRFTFSNYAMSWVRQAPGKGLEWVSAISGSGASTYYADSVKGRFTISRDNSKNTLYLQMNSLRAEDTAVYYCSNLYGDYDYWGQGTLVTVSSGGGGGSGGGGSGGGGSQSVLTQPASVSGSPGQSITISCTGTSSDVGGYNYVSWYQQHPGKAPKLMIYDVSNRPSGVSNRFSGSKSGNTASLTISGLQAEDEADYYCSSYTSSSTLLFGGGTKLTVLG

SEQ ID NO: 465 - protein, 245 aa, Artificial Sequence
  source: /note="Description of Artificial Sequence: Synthetic scFv sequence"
QVQLQESGGGLVQPGGSLRLSCAASGFTFSNYAMSWVRQAPGKGLEWVSAISGSGGSTYYADSVKGRFTISRDNSKNTLYLQMNSLRAEDTAVYYCAKDRFRAAAYWGQGTLVTVSSGGGGGSGGGGSGGGGSQSVLTQPPSVSAAPGQKVTISCTGSSSNIGAGYDVHWYQQLPGTAPKLLIYGNSNRPSGVPDRFSGSKSGTSASLAISGLQSEDEADYYCAAWDDILNGEIFGGGTKVTVLG

SEQ ID NO: 466 - protein, 245 aa, Artificial Sequence
  source: /note="Description of Artificial Sequence: Synthetic scFv sequence"
QVQLQESGGGLVQPGGSLRLSCAASGFTFSSYAMSWVRQAPGKGLEWVSAISGSGGSTYYADSVKGRFTISRDNSKNTLYLQMNSLRAEDTAVYYCASQHVGEQSRYFDYWGQGTLVTVSSGGGGGSGGGGSGGGGSDIVMTQSPSSLSASIGDRVTITCRASHSISSYVNWYQKKPGKAPNLLIYAASYLPRGVPSRFSGSGLGTDFTLTISNLQPEDFATYYCQESYSTPYSFGQGTKVDIKR

SEQ ID NO: 467 - protein, 255 aa, Artificial Sequence
  source: /note="Description of Artificial Sequence: Synthetic scFv sequence"
QVQLQESGGGVVQPGGSLRLSCAASGFTFSSYSMNWVRQAPGKGLEWVSSISSSSSYIYYADSVKGRFTISRDNAKNSLYLQMNSLRAEDTAVYYCARDLPSDDYGDYDYYYYGMDVWGQGTTVTVSSGGGGGSGGGGSGGGGSQSVLTQPPSASGTPGQRVTLFCSGSSSNIASNSVKWYQQPPQRAPKLLMFSDDQRPSGVPVRFSASKSGTSASLAISGLQSEDEADYYCAAWDDSLNAEVFGGGTKVTVLG

SEQ ID NO: 468 - protein, 241 aa, Artificial Sequence
  source: /note="Description of Artificial Sequence: Synthetic scFv sequence"
QVQLQESGGGVVQPGRSLRLSCAASGFTFSSYGMHWVRQAPGKGLEWVSAIGSSGGSTHDADTVKGRFTISRDNAKNSLYLQMNSLRAEDTAVYYCARDRARGFDYWGQGTLVTVSSGGGGGSGGGGSGGGGSEIVLTQSPSTLSASIGDRVTITCRASQGISSYLAWYQQKPGKAPKLLIYGASSLQSGVPSRFSGRGSGADFTLTISSLQPEDFATYYCQQLISYPLTFGGGTKVEIKR

SEQ ID NO: 469 - protein, 246 aa, Artificial Sequence
  source: /note="Description of Artificial Sequence: Synthetic scFv sequence"
QVQLQESGPGLVKPSATLSLTCAVSGGSISSNHWWSWVRQSPGKGLEWIGEIYTYGGANYNPSLKSRVDISMDKSKNQFSLHLSSVTAADTAVYYCGRHLTGYDCFDIWGQGTLVTVSSGGGGSGGGGSGGGGSAQAVLTQPSSVSGAPGQRVTISCTGSSSNIGAGYDVHWYQQLPGTAPKLLIYGNSNRPSGVPDRFSGSKSGTSASLAITGLQAEDEADYYCQSYDSSLSGVFGTGTQLTVLS

SEQ ID NO: 470 - protein, 241 aa, Artificial Sequence
  source: /note="Description of Artificial Sequence: Synthetic scFv sequence"
QVQLQESGPGLVKPSETLSLTCNVSGGSIRNYFWSWIRQPPGQGLEYIGYIYYSGTTDYNPSLKGRVTISLDTSKTQFSLKLNSVTAADTAFYYCVRGPNKYAFDPWGQGTLVTVSSGGGGSGGGGSGGGGSALSYELTQPPSVSVSPGQTASITCSGDKLGDKFASWYQQKAGQSPVLVIYRDTKRPSGIPERFSGSNSGNTATLTISGTQAMDEADYYCQAWDSSTAVFGTGTKVTVLG

SEQ ID NO: 471 - protein, 250 aa, Artificial Sequence
  source: /note="Description of Artificial Sequence: Synthetic scFv sequence"
QVQLQESGPGLVKPSGTLSLTCAVSGDSISSSNWWTWVRQPPGKGLEWIGEIFHSGTTNYNPSLNNRVTISLDESRNQFSLELSSVTAADTAIYYCARDSGNYDDNRGYDYWGRGTLVTVSSGGGGSGGGGSGGGGSAQSVLTQPPSVSGAPGQRVTISCAGTSSNIGAGFDVHWYQLLPGRAPKLLIYGNNNRPSGVPDRFSGSKSGTSASLAISGLQSEDEGDYYCAAWDDTVGGPVFGGGTKLTVLG

SEQ ID NO: 472 - protein, 247 aa, Artificial Sequence
  source: /note="Description of Artificial Sequence: Synthetic scFv sequence"
QVQLQESGPGLVKPSGTLSLTCAVSGGSISSSNWWSWVRQAPGKGLEWIGEIYYGGSTNYNPSLKSRVTLSVDKSKNQFSLRLISVTAADTAVYYCARSSGLYGDYGNLWGRGTLVTVSSGGGGSGGGGSGGGGSAQSVVTQPPSVSAAPGQKVTISCSGSASNIGDHYISWYQQFPGTAPKLLISDNDQRPSGIPDRFSGSKSGTSATLGITGLQTGDEADYYCGTWDSNLSSWVFGSGTKVTVLG

SEQ ID NO: 473 - protein, 251 aa, Artificial Sequence
  source: /note="Description of Artificial Sequence: Synthetic scFv sequence"
QVQLQESGPGLVKPSGTLSLTCAVSGGSISSTNWWSWVRQPPGKGLEWIGEIYHSGSTNYNPSLKSRVTISVDKSKNHFSLNLSSVTAADTAVYYCARDSMGSTGWHYGMDLWGQGTTVTVSSGGGGSGGGGSGGGGSAQSALTQPASVSGSPGQSITISCTGTSSDVGGYNYVSWYQQHPGKAPKLMIYEVSNRPLGVSNRFSGSKSGNTASLTISGLQAEDEGDYYCSSYTSSTTLIVFGGGTKLTVLG

SEQ ID NO: 474 - protein, 250 aa, Artificial Sequence
  source: /note="Description of Artificial Sequence: Synthetic scFv sequence"
QVQLQESGPGLVKPSGTLSLTCAVSGGSISSTNWWSWVRQPPGKGLEWIGEIYHSGSTNYNPSLKSRVTISVDKSKNHFSLNLSSVTAADTAVYYCARDSMGSTGWHYGMDLWGRGTLVTVSSGGGGSGGGGSGGGGSAQSALTQPAAVSGSPGQSITISCTGSSSDVGGYNYVSWYQQHPGKAPKLLIYDVSDRPSGVSYRFSGSKSGNTASLTISGLQAEDEADYYCSSYTATGTLVFGGGTKLTVLG

SEQ ID NO: 475 - protein, 251 aa, Artificial Sequence
  source: /note="Description of Artificial Sequence: Synthetic scFv sequence"
QVQLQESGPGLVKPSGTLSLTCAVSGGSISTSDWWSWVRRPPGKGLEWIGEIYHSGSTNYHPSLKSRVTISLDKSKNQFSLKLSSVTAADTAVYYCAREGGHSGSYPLDYWGKGTLVTVSSGGGGSGGGGSGGGGSALNFMLTQPHSVSESPGKTVTISCTRSSGSIASNYVQWYQQRPGSSPTTVIYEDNQRPSGVPDRFSGSIDSSSNSASLTISGLKTEDEADYYCQSYDSSNQGVVFGGGTKLTVLG

SEQ ID NO: 476 - protein, 249 aa, Artificial Sequence
  source: /note="Description of Artificial Sequence: Synthetic scFv sequence"
QVQLQESGPGLVKPSGTLSLTCAVSGGSISTSDWWSWVRRPPGKGLEWIGEIYHSGSTNYHPSLKSRVTISLDKSKNQFSLKLSSVTAADTAVYYCAREGGHSGSYPLDYWGQGTLVTVSSGGGGSGGGGSGGGGSALNFMLTQPHSVSESPGKTVTISCTRSSGSIASKYVQWYQQRPGSAPTSVIYEDNQRPSGVPDRFSGSIDSASNSASLTISGLKTEDEADYYCQSDDGSSVVFGGGTKVTVLG

SEQ ID NO: 477 - protein, 251 aa, Artificial Sequence
  source: /note="Description of Artificial Sequence: Synthetic scFv sequence"
QVQLQESGPGLVKPSGTLSLTCAVSGGSISTSDWWSWVRRPPGKGLEWIGEIYHSGSTNYHPSLKSRVTISLDKSKNQFSLKLSSVTAADTAVYYCAREGGHSGSYPLDYWGQGTLVTVSSGGGGSGGGGSGGGGSALNFMLTQPHSVSGSPGRTVTISCTRSSGSIATNYVQWYQQRPGSSPTIVIYEDNQRPSGVPDRFSGSIDTSSNSASLTISGLKTEDEADYYCQSYDSNNLGVVFGGGTQLTVLS

SEQ ID NO: 478 - protein, 248 aa, Artificial Sequence
  source: /note="Description of Artificial Sequence: Synthetic scFv sequence"
QVQLQESGPGLVKPSGTLSLTCAVSGGSISTSDWWSWVRRPPGKGLEWIGEIYHSGSTNYHPSLKSRVTISLDKSKNQFSLKLSSVTAADTAVYYCAREGGHSGSYPLDYWGQGTLVTVSSGGGGSGGGGSGGGGSAQSVLTQPPSVSGTTGQRVILSCSGGNSNIGYNSVNWYQQLPGTAPKLLIYTDDQRPSGVPDRFSGSRSGTSASLAISGLQSEDEADYYCATWDDSLNAGVFGGGTKLTVLG

SEQ ID NO: 479 - protein, 250 aa, Artificial Sequence
  source: /note="Description of Artificial Sequence: Synthetic scFv sequence"
QVQLQESGPGLVKPSGTLSLTCAVSGGSISTSDWWSWVRRPPGKGLEWIGEIYHSGSTNYHPSLKSRVTISLDKSKNQFSLKLSSVTAADTAVYYCAREGGHSGSYPLDYWGRGTLVTVSSGGGGSGGGGSGGGGSALNFMLTQPHSVSESPGKTATISCTGSGGSIARSYVQWYQQRPGRAPSIVIYEDYQRPSGVPDRFSGSIDSSSNSASLTITGLKTDDEADYYCQSSDDNNNVVFGGGTKVTVLG

SEQ ID NO: 480 - protein, 248 aa, Artificial Sequence
  source: /note="Description of Artificial Sequence: Synthetic scFv sequence"
QVQLQESGPGLVKPSGTLSLTCAVSGGSISTSDWWSWVRRPPGKGLEWIGEIYHSGSTNYHPSLKSRVTISLDKSKNQFSLKLSSVTAADTAVYYCAREGGHSGSYPLDYWGRGTLVTVSSGGGGSGGGGSGGGGSAQAVLTQPSSVSAAPGQKVTISCSGSSSNIGNNYVSWYQQLPGTAPKLLIYDNNERPSGIPDRFSGSKSGTSATLGITGLQTGDEADYYCGTWDSSLSTVVFGTGTKVTVLG

SEQ ID NO: 481 - protein, 247 aa, Artificial Sequence
  source: /note="Description of Artificial Sequence: Synthetic scFv sequence"
QVQLQESGPGLVKPSGTLSLTCAVSGGSISTSDWWSWVRRPPGKGLEWIGEIYHSGSTNYHPSLKSRVTISLDKSKNQFSLKLSSVTAADTAVYYCAREGGHSGSYPLDYWGRGTMVTVSSGGGGSGGGGSGGGGSAQSVLTQPPSASGTPGQRVTISCSGSFSNIGGNYVNWYQQLPGTAPKLLIYGNNQRPSGVPDRFSSFKSGTSASLAISGLRSEDEADYYCATWDDSQTVLFGGGTKLTVLG

SEQ ID NO: 482 - protein, 247 aa, Artificial Sequence
  source: /note="Description of Artificial Sequence: Synthetic scFv sequence"
QVQLQESGPGLVRSSGILSLTCSVSGVSVSSNNWWSWVRQTPGKGLEWIGEIYQTGTTNYNPSLKSRVAISLDKSRNQFSLILKSVTAADTAVYYCARTSSAWSNADWGKGTMVTVSSGGGGSGGGGSGGGGSALSSELTQDPSASGSPGQSVSISCTGTSSDVGGYNYVSWYQQHPGKAPKLMISEVTKRPSGVPDRFSGSKSGNTASLTVSGLQAEDEADYYCSSFGANNNYLVFGGGTKLTVLG

SEQ ID NO: 483 - protein, 251 aa, Artificial Sequence
  source: /note="Description of Artificial Sequence: Synthetic scFv sequence"
QVQLQESGPRLVKPSQTLSLTCTVSNDSIISGDYFWSWIRQPPGKGLEWIGNIFYTGSTSYNPSLKSRLTMSLDTSKNQFSLRLSSVTAADTAVYFCARGRQGMNWNSGTYFDSWGRGTLVTVSSGGGGSGGGGSGGGGSALSYVLTQPPSVSVAPGKTANITCGGKNIGNKSVQWYQQKPGQAPVVVMYYDSDRPSGIPERFSGSNAGNTATLTIDRVEAGDEADYYCQVWDKSSDRPVFGGGTKLTVLG

SEQ ID NO: 484 - protein, 244 aa, Artificial Sequence
  source: /note="Description of Artificial Sequence: Synthetic scFv sequence"
QVQLQQSGAEVRKPGASAKVSCKTSGYTFIDYYIHWVRQAPGQGLEWMGWINPVTGASGSSPNFRGRVTLTTDTSGNTAYMELRSLRSDDTAVFYCARRHQQSLDYWGRGTTVTVSSGGGGSGGGGSGGGGSAQSVVTQPPSVSAAPGQKVTISCSGRTSNIGNNYVSWYQQVPGAPPKLLIFDNNKRPSGTPARFSGSKSGTSATLAISGLQTGDEADYYCGTWDTTLRGFVFGPGTKVTVLG

SEQ ID NO: 485 - protein, 249 aa, Artificial Sequence
  source: /note="Description of Artificial Sequence: Synthetic scFv sequence"
QVQLQQSGAEVRKPGASVKISCKTSGYTFMDYYIHWVRQAPGQGLEWMGWSNPVTGTSGSSPKFRGRVTLTTDTSGNTAYLDLRSLRSDDTAVFYCARRHQQSLDYWGQGTLVTVSSGGGGSGGGGSGGGGSAQAVLTQPSSLSASPGASASLTCTLRSDINVGSYSINWYQQKPGSPPQYLLNYRSDSDKQQGSGVPSRFSGSKDASANAGILLISGLQSEDEADYYCMIWYRTAWVFGGGTKVTVLG

SEQ ID NO: 486 - protein, 241 aa, Artificial Sequence
  source: /note="Description of Artificial Sequence: Synthetic scFv sequence"
QVQLVQSGAEVKKPGASVKVSCKASGYTFTDYYMHWVRQAPGEGLEWMGWMNPNSGGTNYAQKFQGRVTMTRDTSISTAYMELSRLRSDDTAVYYCARSHYWDSWSPGTLVTVSSGGGGGSGGGGSGGGGSSALTQPASVSGSPGQSITISCTGTSGDVGGYNYVSWYQQHPGKAPKLMIYDVSNRPSGVSNRFSGSKSGNTASLTISGLQAEDEADYYCTSYAGSRNLVFGGGTKLTVLG

SEQ ID NO: 487 - protein, 245 aa, Artificial Sequence
  source: /note="Description of Artificial Sequence: Synthetic scFv sequence"
QVQLVQSGAEVKKPGASVKVSCKTSGYTFMEYYIHWVRQAPGQGLEWMGWSNPVTGTSGSSPKFRGRVTLTTDTSGNTAYLDLRSLRSDDTAVFYCARRHQQSLDYWGQGTLVTVSSGGGGSGGGGSGGGGSAQSVVTQPPSASGSPGQSVTISCSGYSSSNIGNNAVSWYQQLPGTAPKLLIFDNNKRPSGIPARFSGSQSGTTATLGITGLQTGDEADYFCGTWDSSLSAFVFGSGTKVTVLG

SEQ ID NO: 488 - protein, 250 aa, Artificial Sequence
  source: /note="Description of Artificial Sequence: Synthetic scFv sequence"
QVQLVQSGAEVKKPGESLKISCKGSGYTFTNYWIAWVRQMPGKGLEWMGIIYPDDSDTRYNPSFQGQVTMSADKSIDTAYLQWSSLKASDTAIYYCARPSGWNDNGYFDYWGRGTTVTVSSGGGGSGGGGSGGGGSALNFMLTQPHSVSASPGKTVTLSCTGSSGSIASNYVQWYRQRPGSAPTTVIYDDNQRPSGVPDRFSGSIDSSSNSASLTISGLKTEDEADYYCQSFDNDNHWVFGGGTKLTVLG

SEQ ID NO: 489 - protein, 244 aa, Artificial Sequence
  source: /note="Description of Artificial Sequence: Synthetic scFv sequence"
QVQLVQSGAEVRKPGASVKVSCKTSGYTFIDYYIHWVRQAPGQGLEWMGWVNPVTGTSGSSPNFRGRVTMTTDTSGNTAYMELRSLRSDDTAVFYCARRHQQSLDYWGQGTLVTVSSGGGGSGGGGSGGGGSAQSVLTQPPSVSAPPGQKVTISCSGSSSNIGTNYVSWYQQLPGTAPKLLIYDNHKRPSVIPDRFSGSKSGTSATLGISGLQTGDEADYYCGTWDYSLSTWVFGGGTKLTVLG

SEQ ID NO: 490 - protein, 244 aa, Artificial Sequence
  source: /note="Description of Artificial Sequence: Synthetic scFv sequence"
QVQLVQSGAEVRKPGASVKVSCKTSGYTFIEYYIHWVRQAPGQGLEWMGWSNPVTGTSGSSPKFRGRVTLTTDTSGNTAYLDLRSLRSDDTAVFYCARRHQQSLDYWGRGTTVTVSSGGGGSGGGGSGGGGSAQSVLTQPPSVSAAPGQKVTISCSGTNSNIGNYYVSWYQQLPGTAPKLLIYDNNKRPSGVPDRFSGSKSGTSASLVISGLRSEDEADYYCAAWDGSLTAWVFGGGTKVTVLG

SEQ ID NO: 491 - protein, 244 aa, Artificial Sequence
  source: /note="Description of Artificial Sequence: Synthetic scFv sequence"
QVQLVQSGAEVRKPGASVKVSCKTSGYTFMDYYIHWVRQAPGQGLEWMGWSNPVTGTSGSSPKFRGRVTLTTDTSGNTAYLDLRSLRSDDTAVFYCARRHQQSLDYWGQGTMVTVSSGGGGSGGGGSGGGGSAQSVLTQPPSVSAAPGQKVTISCSGSSSNIGNNYVSWYQQLPGTAPKLLMYENSKRPSGIPDRFSGSKSGTSGTLGITGLQTGDEADYYCGTWDTSLRAWVFGGGTKVTVLG

SEQ ID NO: 492 - protein, 245 aa, Artificial Sequence
  source: /note="Description of Artificial Sequence: Synthetic scFv sequence"
QVQLVQSGAEVRKPGASVRVSCKTSGYTFLEYYIHWVRQAPGQGLEWMAWSNPVTGTSGSSPKFRGRVTLTADTSGNTAYLDLKSLTSDDTAIFYCARRHQQSLDYWGQGTLVTVSSGGGGSGGGGSGGGGSAQSVLTQPPSVSAAPGQTVTISCSGSNSNIGNNHVSWYRQLPETAPKLLIYDNNKRPSGIPDRFSGSKSGTSATLDITGLQTGDEADYYCATWDNSLSAPWVFGGGTKLTVLG

SEQ ID NO: 493 - protein, 246 aa, Artificial Sequence
  source: /note="Description of Artificial Sequence: Synthetic scFv sequence"
QVQLVQSGGGLVQPGGSLRLSCAASGFTFSSYAMSWVRQAPGKGLEWVSAISGSGGSTYYADSVKGRFTISRDNSKNTLYLQMNSLRAEDTAVYYCAKSSSSWYRSYYFDYWGQGTLVTVSSGGGGGSGGGGSGGGGSQSALTQDPAVSVALGQTVRITCRGDSLRNYYASWYQQKPGQAPVLVIYGKNNRPSGIPDRFSGSFSGNTASLTITGAQAEDEADYYCNSRDSSANQMFGGGTKVTVLG

SEQ ID NO: 494 - protein, 253 aa, Artificial Sequence
  source: /note="Description of Artificial Sequence: Synthetic scFv sequence"
QVQLVQSGPEVKKPGASVEVSCKASGYTFTGDYMHWVRQAPGQGPEWMGWINPQTGVTKYAQKFQGRVTMARDTSINTAYMELRGLRSDDTAVYYCVREDHNYDLWSAYNGLDVWGQGTLVTVSSGGGGSGGGGSGGGGSAQSVLTQPPSVSAAPGQKVTISCSGSSSNIGNNHVSWYQQLAGTAPKLLIFDNDKRPSGIPDRFSGSKSGTSATLGITGLQTGDEADYYCGTWDKSPTDIYVFGSGTKLTVLG

SEQ ID NO: 495 - protein, 243 aa, Artificial Sequence
  source: /note="Description of Artificial Sequence: Synthetic scFv sequence"
EVQLVESGGGLVQPGGSLRLSCAASGFDFSRYWMSWVRQAPGKGLEWIGEINPDSSTINYAPSLKDKFIISRDNAKSLYLQMNSLRAEDTAVYYCARPDGNYWYFDVWGQGTLVTVSSGSTSGGGSGGGSGGGGSSDIQMTQSPSSLSASVGDRVTITCKASQDVGIAVAWYQQKPGKVPKLLIYWASTRHTGVPDRFSGSGSGTDFTLTISSLQPEDVATYYCQQYSSYPYTFGQGTKVEIK

SEQ ID NO: 496 - protein, 259 aa, Artificial Sequence
  source: /note="Description of Artificial Sequence: Synthetic scFv sequence"
MEFGLSWLFLVAILKGVQCSRMAQVKLKESGPELKKPGETVKISCKASGYTFTDYSMHWVKKTPGKGLKWLGWINTATGEPTYADDFKGRFAISLETSARTVYLQINNLRNEDTATYFCFSYYDYWGQGTTVTVSSGGGGSGGGGSGGGGLDIKLTQSPSILSVTPGETVSLSCRASQTIYKNLHWYQQKSHRSPRLLIKYGSDSISGIPSRFTGSGSGTDYTLNINSVKPEDEGIYYCLQGYSTPWTFGGGTKLEIKR

SEQ ID NO: 497 - protein, 219 aa, Artificial Sequence
  source: /note="Description of Artificial Sequence: Synthetic scFv sequence"
DIVMTQSPSSLAVSLGERATMSCKSSQSLFNSRTRKNYLAWYQQKPGQSPKLLIYWASARDSGVPARFTGSGSETYFTLTISRVQAEDLAVYYCMQSFNLRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 498 - protein, 450 aa, Artificial Sequence
  source: /note="Description of Artificial Sequence: Synthetic scFv sequence"
EVNLVESGGGLVQPGRSLRLSCTASGFTFTDNYMSWVRQAPGKGLEWLGFIRNKANGYTTDYAASVRGRFTISRDNSKSILYLQMNALRTEDTAVYYCARDVGSNYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 499 - protein, 450 aa, Artificial Sequence
  source: /note="Description of Artificial Sequence: Synthetic scFv sequence"
EVQLVESGGGLVQPGRSLRLSCTASGFTFTDNYMSWVRQAPGKGLEWLGFIRNKANGYTTEYAASVKGRFTISRDNSKSIAYLQMNSLKTEDTAVYYCARDVGSNYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 500 - protein, 450 aa, Artificial Sequence
  source: /note="Description of Artificial Sequence: Synthetic scFv sequence"
EVQLVESGGGLVQPGRSLRLSCTASGFTFTDNYMSWVRQAPGKGLEWVGFIRNKANGYTTEYAASVKGRFTISRDDSKSIAYLQMNSLKTEDTAVYYCARDVGSNYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 501 - protein, 250 aa, Artificial Sequence
  source: /note="Description of Artificial Sequence: Synthetic scFv sequence"
SYELTQPPSVSGTPGQRVAISCSGSSSNIGTRMVTWYQHVPGTAPKLLIFNNNQRPSGVPDRFSASKSGTSASLAIIGLQSDDEADYYCAAWDDNLKSYVFGTGTKVTVLGSRGGGGSGGGGSDGGGSLEMAQVQLQQWGAGLLKPSETLSLTCAVYGGSFSGYYWSWIRQLPGKGLEWIGEINHSGSTNYNPYLKSRVTISVDTSKRQFSLKLSSVTAADTAVYYCARAPQSWYVGDVWGQGTLVTVSS

SEQ ID NO: 502 - protein, 250 aa, Artificial Sequence
  source: /note="Description of Artificial Sequence: Synthetic scFv sequence"
SYELTQPPSVSGTPGQRVAISCSGSSSNIGTRMVTWYQHVPGTAPKLLIFNNNQRPSGVPDRFSASKSGTSASLAIIGLQSDDEADYYCAAWDDNLKSYVFGTGTKVTVLGSRGGGGSGGGGSGGGGSLEMAQVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARAPQSWYRGDVWGQGTLVTVSS

SEQ ID NO: 503 - protein, 250 aa, Artificial Sequence
  source: /note="Description of Artificial Sequence: Synthetic scFv sequence"
SYELTQPPSVSGTPGQRVAISCSGSSSNIGTRMVTWYQHVPGTAPKLLIFNNNQRPSGVPDRFSASKSGTSASLAIIGLQSDDEADYYCAAWDDNLKSYVFGTGTKVTVLGSRGGGGSGGGGSGGGGSLEMAQVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCLRAPQSWYVGDVWGQGTLVTVSS

SEQ ID NO: 504 - protein, 250 aa, Artificial Sequence
  source: /note="Description of Artificial Sequence: Synthetic scFv sequence"
SYELTQPPSVSGTPGQRVAISCSGSSSNIGTRMVTWYQHVPGTAPKLLIFNNNQRPSGVPDRFSASKSGTSASLAIIGLQSDDEADYYCAAWDDNLKSYVFGTGTKVTVLGSRGGGGSGGGGSGGGGSLEMAQVQLQQWGAGLLKPSETMSLTCAVYGGSFSGYYWSWIRQPPGKGLEWIGEINHSGSTNYNPSLKSRVTISVDTSKNQFSLKLSSVTAADTAVYYCARAPQSWYRGDVWGQGTLVTVSS

SEQ ID NO: 505 - protein, 250 aa, Artificial Sequence
  source: /note="Description of Artificial Sequence: Synthetic scFv sequence"
SYELTQPPSVSGTPGQRVAISCSGSSSNIGTRMVTWYQHVPGTAPKLLIFNNNQRPSGVPDRFSASKSGTSASLAIIGLQSDDEADYYCAAWDDNPKSYHFGTGTKVTVLGSRGGGGSGGGGSGGGGSLEMAQVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARAPQSWYVGDVWGQGTLVTVSS

SEQ ID NO: 506 - protein, 250 aa, Artificial Sequence
  source: /note="Description of Artificial Sequence: Synthetic scFv sequence"
SYELTQPPSVSGTPGQRVAISCSGSSSNIGTRMVTWYQHVPGTAPKLLIFNNNQRPSGVPDRFSASKSGTSASLAIIGLQSDDEADYYCATWDDNVKSYVFGTGTKVTVLGSRGGGGSGGGGSGGGGSLEMAQVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARAPQSWYVGDVWGQGTLVTVSS

SEQ ID NO: 507 - protein, 250 aa, Artificial Sequence
  source: /note="Description of Artificial Sequence: Synthetic scFv sequence"
SYELTQPPSVSGTPGQRVAISCSGSSSNIGTRMVTWYQHVPGTAPKLLIFNNNQRPSGVPDRFSASKSGTSASLAIIGLQSDDEADYYCATWDENPKSYVFGTGTKVTVLGSRGGGGSGGGGSGGGGSLEMAQVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARAPQSWYVGDVWGQGTLVTVSS

SEQ ID NO: 508 - protein, 250 aa, Artificial Sequence
  source: /note="Description of Artificial Sequence: Synthetic scFv sequence"
SYELTQPPSVSGTPGQRVAISCSGSSSNIGTRMVTWYQHVPGTAPKLLIFNNNQRPSGVPDRFSASKSGTSASLAIIGLQSDDEADYYCATWEDNRKSYVFGTGTKVTVLGSRGGGGSGGGGSGGGGSLEMAQVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARAPQSWYVGDVWGQGTLVTVSS

SEQ ID NO: 509 - protein, 250 aa, Artificial Sequence
  source: /note="Description of Artificial Sequence: Synthetic scFv sequence"
SYELTQPPSVSGTPGQRVAISCSGSSSNIGTRMVTWYQHVPGTAPKLLIFNNNQRPSGVPDRFSASKSGTSASLTIIGLQSDDEADYYCAAWDDNLKSYVFGTGTKVTVLGSRGGGGSGGGGSGGGGSLEMAQVQLQQWGAGLLKPSETLSLTCAVYGGSFSGYYWSWIRQPPGKGLEWIGEINHSGSTNYNPSLKSRVTMSVDTSKRQFSLKLSSVTAADTAVYYCARAPQSWYVGDVWGQGTLVTVSS

SEQ ID NO: 510 - protein, 250 aa, Artificial Sequence
  source: /note="Description of Artificial Sequence: Synthetic scFv sequence"
SYELTQPPSVSGTPGQRVAISCSGSSSNIGTRVVTWYQHVPGTAPKLLIFNNNQRPSGVPDRFSASKSGTSASLAIIGLQSDDEADYYCAAWDDNLKSYVFGTGTKVTVLGSRGGGGSGGGGSGGGGSLEMAQVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARAPQSWYVGDVWGQGTLVTVSS

SEQ ID NO: 511 - protein, 240 aa, Artificial Sequence
  source: /note="Description of Artificial Sequence: Synthetic scFv sequence"
DIQMTQSPSSLSASVGDRVTITCRASQGIRNNLAWYQQKPGKAPKRLIYAASNLQSGVPSRFTGSGSGTEFTLIVSSLQPEDFATYYCLQHHSYPLTSGGGTKVEIKRTGSTSGSGKPGSGEGSEVQVLESGGGLVQPGGSLRLSCAASGFTFSSYAMSWVRQAPGKGLEWVSAISGSGGSTNYADSVKGRFTISRDNSKNTLYLQMNSLRAEDTAVYYCAGSSGWSEYWGQGTLVTVSS

SEQ ID NO: 512 - protein, 126 aa, Artificial Sequence
  source: /note="Description of Artificial Sequence: Synthetic scFv sequence"
EAQLVQSGAEGKKPGSSVKVSCKAPGGTFNSYAISWVRQAPGQGLEWMGGIIPIFGTAYYAQKFQGRVTITADESTSTAYMELSSLRSEDTAVYYCAREEGPYCSSTSCYAAFDIWGRGTLVTVSS

SEQ ID NO: 513 - protein, 126 aa, Artificial Sequence
  source: /note="Description of Artificial Sequence: Synthetic scFv sequence"
EAQLVQSGAEGKKPGSSVKVSCKAPGGTFNSYAISWVRQAPGQGLEWMGGIIPIFGTAYYAQKFQGRVTITADESTSTAYMELSSLRSEDTAVYYCAREEGPYCSSTSCYGAFDIWGRGTLVTVSS

SEQ ID NO: 514 - protein, 126 aa, Artificial Sequence
  source: /note="Description of Artificial Sequence: Synthetic scFv sequence"
EVQLVQSGAEVKKLGSSVKVSCKASGGTFSSYAISWVRQAPGQGLEWVGGIIPIFGTANYAQKFQGRVKITADESASTAYMELSSLRSEDTAVYYCAREEGPYCSSTSCYGAFDIWGQGTLVTVSS

SEQ ID NO: 515 - protein, 126 aa, Artificial Sequence
  source: /note="Description of Artificial Sequence: Synthetic scFv sequence"
EVQLVQSGAEVKKPGSSVKVSCKASGGTFSSYAIGWVRQAPGQGLEWMGGIIPIFGIANYAQKFQGRVTITADESTSSAYMELSSLRSEDTAVYYCAREEGPYCSSTSCYAAFDIWGQGTLVTVSS

SEQ ID NO: 516 - protein, 126 aa, Artificial Sequence
  source: /note="Description of Artificial Sequence: Synthetic scFv sequence"
EVQLVQSGAEVKKPGSSVKVSCKASGGTFSSYAIGWVRQAPGQGLEWMGGIIPIFGIANYAQKFQGRVTITADESTSSAYMELSSLRSEDTAVYYCAREEGPYCSSTSCYGAFDIWGQGTLVTVSS

SEQ ID NO: 517 - protein, 126 aa, Artificial Sequence
  source: /note="Description of Artificial Sequence: Synthetic scFv sequence"
EVQLVQSGAEVKKPGSSVKVSCKASGGTFSSYAISWVRQAPGQGLEWMGGIIPIFGTANYAQKFQGRVTITADESTSTAYMELSSLRSEDTAVYYCAREEGPYCSSTSCYAAFDIWGQGTLVTVSS

SEQ ID NO: 518 - protein, 126 aa, Artificial Sequence
  source: /note="Description of Artificial Sequence: Synthetic scFv sequence"
EVQLVQSGAEVKKPGSSVKVSCKASGGTFSSYAISWVRQAPGQGLEWMGGIIPIFGTANYAQKFQGRVTITADESTSTAYMELSSLRSEDTAVYYCAREEGPYCSSTSCYGAFDIWGQGTLVTVSS

SEQ ID NO: 519 - protein, 126 aa, Artificial Sequence
  source: /note="Description of Artificial Sequence: Synthetic scFv sequence"
EVQLVQSGAEVKKPGSSVKVSCKASGGTFSSYAISWVRQAPGQGLEWVGGIIPIFGTANYAQKFQGRVKITADESASTAYMELSSLRSEDTAVYYCAREEGPYCSSTSCYAAFDIWGQGTLVTVSS

SEQ ID NO: 520 - protein, 126 aa, Artificial Sequence
  source: /note="Description of Artificial Sequence: Synthetic scFv sequence"
EVQLVQSGAEVKKPGSSVKVSCKASGGTFSSYAISWVRQAPGQGLEWVGGIIPIFGTANYAQKFQGRVKITADESASTAYMELSSLRSEDTAVYYCAREEGPYCSSTSCYGAFDIWGQGTLVTVSS

SEQ ID NO: 521 - protein, 261 aa, Artificial Sequence
  source: /note="Description of Artificial Sequence: Synthetic scFv sequence"
HAARPDVVMTQSPDSLAVSLGERATINCKSSQSLLDSDGKTYLNWLQQKPGQPPKRLISLVSKLDSGVPDRFSGSGSGTDFTLTISSLQAEDVAVYYCWQGTHFPGTFGGGTKVEIKGGGGSGGGGSGGGGSGGGGSEIQLVQSGAEVKKPGATVKISCKGSGFNIEDYYIHWVQQAPGKGLEWMGRIDPENDETKYGPIFQGRVTITADTSTNTVYMELSSLRSEDTAVYYCAFRGGVYWGQGTTVTVSSGSHHHHHHHH

SEQ ID NO: 522 - protein, 269 aa, Artificial Sequence
  source: /note="Description of Artificial Sequence: Synthetic scFv sequence"
MALPVTALLLPLALLLHAARPDIQMTQSPSSLSASVGDRVTITCRASQGIRNNLAWYQQKPGKAPKRLIYAASNLQSGVPSRFTGSGSGTEFTLIVSSLQPEDFATYYCLQHHSYPLTSGGGTKVEIKRTGSTSGSGKPGSGEGSEVQVLESGGGLVQPGGSLRLSCAASGFTFSSYAMSWVRQAPGKGLEWVSAISGSGGSTNYADSVKGRFTISRDNSKNTLYLQMNSLRAEDTAVYYCAGSSGWSEYWGQGTLVTVSSHHHHHHHH

SEQ ID NO: 523 - protein, 278 aa, Artificial Sequence
  source: /note="Description of Artificial Sequence: Synthetic scFv sequence"
MALPVTALLLPLALLLHAARPDVVMTQSPDSLAVSLGERATINCKSSQSLLDSDGKTYLNWLQQKPGQPPKRLISLVSKLDSGVPDRFSGSGSGTDFTLTISSLQAEDVAVYYCWQGTHFPGTFGGGTKVEIKGGGGSGGGGSGGGGSGGGGSEIQLVQSGAEVKKPGESLRISCKGSGFNIEDYYIHWVRQMPGKGLEWMGRIDPENDETKYGPIFQGHVTISADTSINTVYLQWSSLKASDTAMYYCAFRGGVYWGQGTTVTVSSGSHHHHHHHHH

SEQ ID NO: 524 - protein, 277 aa, Artificial Sequence
  source: /note="Description of Artificial Sequence: Synthetic scFv sequence"
MALPVTALLLPLALLLHAARPDVVMTQSPLSLPVTLGQPASISCKSSQSLLDSDGKTYLNWLQQRPGQSPRRLISLVSKLDSGVPDRFSGSGSGTDFTLKISRVEAEDVGVYYCWQGTHFPGTFGGGTKVEIKGGGGSGGGGSGGGGSGGGGSEIQLVQSGAEVKKPGATVKISCKGSGFNIEDYYIHWVQQAPGKGLEWMGRIDPENDETKYGPIFQGRVTITADTSTNTVYMELSSLRSEDTAVYYCAFRGGVYWGQGTTVTVSSGSHHHHHHHH

SEQ ID NO: 525 - protein, 277 aa, Artificial Sequence
  source: /note="Description of Artificial Sequence: Synthetic scFv sequence"
MALPVTALLLPLALLLHAARPDVVMTQSPLSLPVTLGQPASISCKSSQSLLDSDGKTYLNWLQQRPGQSPRRLISLVSKLDSGVPDRFSGSGSGTDFTLKISRVEAEDVGVYYCWQGTHFPGTFGGGTKVEIKGGGGSGGGGSGGGGSGGGGSEIQLVQSGAEVKKPGESLRISCKGSGFNIEDYYIHWVRQMPGKGLEWMGRIDPENDETKYGPIFQGHVTISADTSINTVYLQWSSLKASDTAMYYCAFRGGVYWGQGTTVTVSSGSHHHHHHHH

SEQ ID NO: 526 - protein, 274 aa, Artificial Sequence
  source: /note="Description of Artificial Sequence: Synthetic scFv sequence"
MALPVTALLLPLALLLHAARPEIQLQQSGAELVKPGASVKLSCTGSGFNIEDYYIHWVKQRTEQGLEWIGRIDPENDETKYGPIFQGRATITADTSSNTVYLQLSSLTSEDTAVYYCAFRGGVYWGPGTTLTVSSGGGGSGGGGSGGGGSHMDVVMTQSPLTLSVAIGQSASISCKSSQSLLDSDGKTYLNWLLQRPGQSPKRLISLVSKLDSGVPDRFTGSGSGTDFTLRISRVEAEDLGIYYCWQGTHFPGTFGGGTKLEIKGSHHHHHHHH

SEQ ID NO: 527 - protein, 277 aa, Artificial Sequence
  source: /note="Description of Artificial Sequence: Synthetic scFv sequence"
MALPVTALLLPLALLLHAARPEIQLVQSGAEVKKPGATVKISCKGSGFNIEDYYIHWVQQAPGKGLEWMGRIDPENDETKYGPIFQGRVTITADTSTNTVYMELSSLRSEDTAVYYCAFRGGVYWGQGTTVTVSSGGGGSGGGGSGGGGSGGGGSDVVMTQSPDSLAVSLGERATINCKSSQSLLDSDGKTYLNWLQQKPGQPPKRLISLVSKLDSGVPDRFSGSGSGTDFTLTISSLQAEDVAVYYCWQGTHFPGTFGGGTKVEIKGSHHHHHHHH

SEQ ID NO: 528 - protein, 277 aa, Artificial Sequence
  source: /note="Description of Artificial Sequence: Synthetic scFv sequence"
MALPVTALLLPLALLLHAARPEIQLVQSGAEVKKPGATVKISCKGSGFNIEDYYIHWVQQAPGKGLEWMGRIDPENDETKYGPIFQGRVTITADTSTNTVYMELSSLRSEDTAVYYCAFRGGVYWGQGTTVTVSSGGGGSGGGGSGGGGSGGGGSDVVMTQSPLSLPVTLGQPASISCKSSQSLLDSDGKTYLNWLQQRPGQSPRRLISLVSKLDSGVPDRFSGSGSGTDFTLKISRVEAEDVGVYYCWQGTHFPGTFGGGTKVEIKGSHHHHHHHH

SEQ ID NO: 529 - protein, 278 aa, Artificial Sequence
  source: /note="Description of Artificial Sequence: Synthetic scFv sequence"
MALPVTALLLPLALLLHAARPEIQLVQSGAEVKKPGESLRISCKGSGFNIEDYYIHWVRQMPGKGLEWMGRIDPENDETKYGPIFQGHVTISADTSINTVYLQWSSLKASDTAMYYCAFRGGVYWGQGTTVTVSSGGGGSGGGGSGGGGSGGGGSDVVMTQSPDSLAVSLGERATINCKSSQSLLDSDGKTYLNWLQQKPGQPPKRLISLVSKLDSGVPDRFSGSGSGTDFTLTISSLQAEDVAVYYCWQGTHFPGTFGGGTKVEIKGSHHHHHHHHH

SEQ ID NO: 530 - protein, 277 aa, Artificial Sequence
  source: /note="Description of Artificial Sequence: Synthetic scFv sequence"
MALPVTALLLPLALLLHAARPEIQLVQSGAEVKKPGESLRISCKGSGFNIEDYYIHWVRQMPGKGLEWMGRIDPENDETKYGPIFQGHVTISADTSINTVYLQWSSLKASDTAMYYCAFRGGVYWGQGTTVTVSSGGGGSGGGGSGGGGSGGGGSDVVMTQSPLSLPVTLGQPASISCKSSQSLLDSDGKTYLNWLQQRPGQSPRRLISLVSKLDSGVPDRFSGSGSGTDFTLKISRVEAEDVGVYYCWQGTHFPGTFGGGTKVEIKGSHHHHHHHH

SEQ ID NO: 531 - protein, 363 aa, Artificial Sequence
  source: /note="Description of Artificial Sequence: Synthetic scFv sequence"
MATGSRTSLLLAFGLLCLPWLQEGSAAPDVQDCPECTLQENPFFSQPGAPILQCMGCCFSRAYPTPLRSKKTMLVQKNVTSESTCCVAKSYNRVTVMGGFKVENHTACHCSTCGFSASPAFFQVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSAGGGGSGGGGSGGGGSDILLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELK

SEQ ID NO: 532 - protein, 232 aa, Artificial Sequence
  source: /note="Description of Artificial Sequence: Synthetic scFv sequence"
MATGSRTSLLLAFGLLCLPWLQEGSAAPDVQDCPECTLQENPFFSQPGAPILQCMGCCFSRAYPTPLRSKKTMLVQKNVTSESTCCVAKSYNRVTVMGGFKVENHTACHCSTCQVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 533 - protein, 353 aa, Artificial Sequence
  source: /note="Description of Artificial Sequence: Synthetic scFv sequence"
MATGSRTSLLLAFGLLCLPWLQEGSAAPDVQDCPECTLQENPFFSQPGAPILQCMGCCFSRAYPTPLRSKKTMLVQKNVTSESTCCVAKSYNRVTVMGGFKVENHTACHCSTCQVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSAGGGGSGGGGSGGGGSDILLTQSPVILSSPGERVSFSCRASQSIGTNIHWYQQRTNGSPRLLIKYASESISGIPSRFSGSGSGTDFTLSINSVESEDIADYYCQQNNNWPTTFGAGTKLELK

SEQ ID NO: 534 - protein, 222 aa, Artificial Sequence
  source: /note="Description of Artificial Sequence: Synthetic scFv sequence"
MATGSRTSLLLAFGLLCLPWLQEGSADILLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELKAAAPDVQDCPECTLQENPFFSQPGAPILQCMGCCFSRAYPTPLRSKKTMLVQKNVTSESTCCVAKSYNRVTVMGGFKVENHTACHCSTC

SEQ ID NO: 535 - protein, 616 aa, Artificial Sequence
  source: /note="Description of Artificial Sequence: Synthetic scFv sequence"
MATGSRTSLLLAFGLLCLPWLQEGSADIQMTQSPSSLSASVGDRVTITCITSNDIDDDMNWYQQKPGKAPKLLISEGNTLRPGVPSRFSGSGYGTDFTLTISSLQPEDVATYYCFQSDNLPYTFGQGTKVEIKGGGGSGGGGSGGGGSEVQLVQSGAEVKKPGASVKVSCKASGDTFTTYVIHWMRQAPGQGLEWIGYINPYNDGTKYNEKFKGRVTITSDKSTSTAYMELSSLRSEDTAVYYCARIYYDYDGDYWGQGTLVTVSSAAAPDVQDCPECTLQENPFFSQPGAPILQCMGCCFSRAYPTPLRSKKTMLVQKNVTSESTCCVAKSYNRVTVMGGFKVENHTACHCSTCGGGGSGGGGSGGGGSGGGGSQVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSAGGGGSGGGGSGGGGSDILLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELK

SEQ ID NO: 536 - protein, 658 aa, Artificial Sequence
  source: /note="Description of Artificial Sequence: Synthetic scFv sequence"
MATGSRTSLLLAFGLLCLPWLQEGSAEVQLVESGGGLVQPGGSLRLSCAASGYTFTNYGMNWVRQAPGKGLEWVGWINTYTGEPTYAADFKRRFTFSLDTSKSTAYLQMNSLRAEDTAVYYCAKYPHYYGSSHWYFDVWGQGTLVTVSSGGGGSGGGGSGGGGSDIQMTQSPSSLSASVGDRVTITCSASQDISNYLNWYQQKPGKAPKVLIYFTSSLHSGVPSRFSGSGSGTDFTLTISSLQPEDFATYYCQQYSTVPWTFGQGTKVEIKRSKEPLRPRCRPINATLAVEKEGCPVCITVNTTICAGYCPTMTRVLQGVLPALPQVVCNYRDVRFESIRLPGCPRGVNPVVSYAVALSCQCALCRRSTTDCGGPKDHPLTCDDPRFQDSSSSKAPPPSLPSPSRLPGPSDTPILPQQVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSAGGGGSGGGGSGGGGSDILLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELK

SEQ ID NO: 537 - protein, 616 aa, Artificial Sequence
  source: /note="Description of Artificial Sequence: Synthetic scFv sequence"
MATGSRTSLLLAFGLLCLPWLQEGSAEVQLVQSGAEVKKPGASVKVSCKASGDTFTTYVIHWMRQAPGQGLEWIGYINPYNDGTKYNEKFKGRVTITSDKSTSTAYMELSSLRSEDTAVYYCARIYYDYDGDYWGQGTLVTVSSGGGGSGGGGSGGGGSDIQMTQSPSSLSASVGDRVTITCITSNDIDDDMNWYQQKPGKAPKLLISEGNTLRPGVPSRFSGSGYGTDFTLTISSLQPEDVATYYCFQSDNLPYTFGQGTKVEIKAAAPDVQDCPECTLQENPFFSQPGAPILQCMGCCFSRAYPTPLRSKKTMLVQKNVTSESTCCVAKSYNRVTVMGGFKVENHTACHCSTCGGGGSGGGGSGGGGSGGGGSQVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSAGGGGSGGGGSGGGGSDILLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELK

SEQ ID NO: 538 - protein, 359 aa, Artificial Sequence
  source: /note="Description of Artificial Sequence: Synthetic scFv sequence"
MATGSRTSLLLAFGLLCLPWLQEGSAQVQLQESGPGLVKPSETLSLTCTVSGYSITGGYLWNWIRQPPGKGLEWIGYISYDGTNNYKPSLKDRVTISRDTSKNQFSLKLSSVTAADTAVYYCARYGRVFFDYWGQGTLVTVSSGGGGSGGGGSGGGGSDIVMTQSPLSLPVTPGEPASISCRSSQSIVHSNGNTYLQWYLQKPGQSPQLLIYKVSNRLYGVPDRFSGSGSGTDFTLKISRVEAEDVGVYYCFQGSHVPWTFGQGTKVEIKAAAPDVQDCPECTLQENPFFSQPGAPILQCMGCCFSRAYPTPLRSKKTMLVQKNVTSESTCCVAKSYNRVTVMGGFKVENHTACHCSTC

SEQ ID NO: 539 - protein, 418 aa, Artificial Sequence
  source: /note="Description of Artificial Sequence: Synthetic scFv sequence"
MATGSRTSLLLAFGLLCLPWLQEGSAQVQLQESGPGLVKPSETLSLTCTVSGYSITGGYLWNWIRQPPGKGLEWIGYISYDGTNNYKPSLKDRVTISRDTSKNQFSLKLSSVTAADTAVYYCARYGRVFFDYWGQGTLVTVSSGGGGSGGGGSGGGGSDIVMTQSPLSLPVTPGEPASISCRSSQSIVHSNGNTYLQWYLQKPGQSPQLLIYKVSNRLYGVPDRFSGSGSGTDFTLKISRVEAEDVGVYYCFQGSHVPWTFGQGTKVEIKAAASKEPLRPRCRPINATLAVEKEGCPVCITVNTTICAGYCPTMTRVLQGVLPALPQVVCNYRDVRFESIRLPGCPRGVNPVVSYAVALSCQCALCRRSTTDCGGPKDHPLTCDDPRFQDSSSSKAPPPSLPSPSRLPGPSDTPILPQ

SEQ ID NO: 540 - protein, 278 aa, Artificial Sequence
  source: /note="Description of Artificial Sequence: Synthetic scFv sequence"
MATGSRTSLLLAFGLLCLPWLQEGSASKEPLRPRCRPINATLAVEKEGCPVCITVNTTICAGYCPTMTRVLQGVLPALPQVVCNYRDVRFESIRLPGCPRGVNPVVSYAVALSCQCALCRRSTTDCGGPKDHPLTCDDPRFQDSSSSKAPPPSLPSPSRLPGPSDTPILPQDILLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELK

SEQ ID NO: 541 - protein, 412 aa, Artificial Sequence
  source: /note="Description of Artificial Sequence: Synthetic scFv sequence"
MATGSRTSLLLAFGLLCLPWLQEGSASKEPLRPRCRPINATLAVEKEGCPVCITVNTTICAGYCPTMTRVLQGVLPALPQVVCNYRDVRFESIRLPGCPRGVNPVVSYAVALSCQCALCRRSTTDCGGPKDHPLTCDDPRFQDSSSSKAPPPSLPSPSRLPGPSDTPILPQQVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSAGGGGSGGGGSGGGGSDILLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELK

SEQ ID NO: 542 - protein, 108 aa, Artificial Sequence
  source: /note="Description of Artificial Sequence: Synthetic scFv sequence"
QSVLTQDPAASVALGQTVKITCQGDSLRSYFASWYQQKPGQAPTLVMYARNDRPAGVPDRFSGSKSGTSASLAISGLQSEDEADYYCAAWDDSLNGYLFGAGTKLTVL

SEQ ID NO: 543 - protein, 108 aa, Artificial Sequence
  source: /note="Description of Artificial Sequence: Synthetic scFv sequence"
QSVLTQDPAVSAALGQTVKITCQGDSLRSYFASWYQQKPGQAPTLVMYARNDRPAGVPDRFSGSKSGTSASLAISGLQSEDEADYYCAAWDDSLNGYLFGAGTKLTVL

SEQ ID NO: 544 - protein, 108 aa, Artificial Sequence
  source: /note="Description of Artificial Sequence: Synthetic scFv sequence"
QSVLTQDPAVSVALGQTVKITCQGDSLRSYFASWYQQKPGQAPTLVMYARNDRPAGVPDRFSGSKSGTSASLAISGLQPEDEADYYCAAWDDSLNGYLFGAGTKLTVL

SEQ ID NO: 545 - protein, 108 aa, Artificial Sequence
  source: /note="Description of Artificial Sequence: Synthetic scFv sequence"
QSVLTQDPAVSVALGQTVKITCQGDSLRSYFASWYQQKPGQAPTLVMYARNDRPAGVPDRFSGSKSGTSASLAISGLQSEDEADYYCAAWDDSLNGYLFGAGTKLTVL

SEQ ID NO: 546 - protein, 108 aa, Artificial Sequence
  source: /note="Description of Artificial Sequence: Synthetic scFv sequence"
QSVLTQDPAVSVALGQTVKITCQGDSLRSYLASWYQQKPGQAPTLVTYARNDRPAGVPDRFSGSKSGTSASLAISGLQSEDEADYYCAAWDDSLNGYLFGAGTKLTVL

SEQ ID NO: 547 - protein, 330 aa, Artificial Sequence
  source: /note="Description of Artificial Sequence: Synthetic scFv sequence"
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSAGGGGSGGGGSGGGGSDILLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELKAAAPDVQDCPECTLQENPFFSQPGAPILQCMGCCFSRAYPTPLRSKKTMLVQKNVTSESTCCVAKSYNRVTVMGGFKVENHTACHCSTC

SEQ ID NO: 548 - protein, 227 aa, Artificial Sequence
  source: /note="Description of Artificial Sequence: Synthetic scFv sequence"
SVKLSCTGSGFNIEDYYIHWVKQRTEQGLEWIGRIDPENDETKYGPIFQGRATITADTSSNTVYLQLSSLTSEDTAVYYCAFRGGVYWGPGTTLTVSSGGGGSGGGGSGGGGSHMDVVMTQSPLTLSVAIGQSASISCKSSQSLLDSDGKTYLNWLLQRPGQSPKRLISLVSKLDSGVPDRFTGSGSGTDFTLRISRVEAEDLGIYYCWQGTHFPGTFGGGTKLEIK

SEQ ID NO: 549 - protein, 249 aa, Artificial Sequence
  source: /note="Description of Artificial Sequence: Synthetic scFv sequence"
SYELTQPPSVSVAPGQTARITCSGDALGDKYASWYQQKPGQAPVLVIYEDSKRPSGIPERFSGSNSGNTATLTISGTQAEDEADYYCSVWDGDWGMPVFGGGTKLTVLGSGGSTITSYNVYYTKLSSSGSEVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARGIIYPSNVAVWGQGTLVTVSS

SEQ ID NO: 550 - protein, 246 aa, Artificial Sequence
  source: /note="Description of Artificial Sequence: Synthetic scFv sequence"
DVVMTQSPDSLAVSLGERATINCKSSQSLLDSDGKTYLNWLQQKPGQPPKRLISLVSKLDSGVPDRFSGSGSGTDFTLTISSLQAEDVAVYYCWQGTHFPGTFGGGTKVEIKGGGGSGGGGSGGGGSGGGGSEIQLVQSGAEVKKPGATVKISCKGSGFNIEDYYIHWVQQAPGKGLEWMGRIDPENDETKYGPIFQGRVTITADTSTNTVYMELSSLRSEDTAVYYCAFRGGVYWGQGTTVTVSS

SEQ ID NO: 551 - protein, 246 aa, Artificial Sequence
  source: /note="Description of Artificial Sequence: Synthetic scFv sequence"
EIQLVQSGAEVKKPGESLRISCKGSGFNIEDYYIHWVRQMPGKGLEWMGRIDPENDETKYGPIFQGHVTISADTSINTVYLQWSSLKASDTAMYYCAFRGGVYWGQGTTVTVSSGGGGSGGGGSGGGGSGGGGSDVVMTQSPLSLPVTLGQPASISCKSSQSLLDSDGKTYLNWLQQRPGQSPRRLISLVSKLDSGVPDRFSGSGSGTDFTLKISRVEAEDVGVYYCWQGTHFPGTFGGGTKVEIK

SEQ ID NO: 552 - protein, 246 aa, Artificial Sequence
  source: /note="Description of Artificial Sequence: Synthetic scFv sequence"
DVVMTQSPLSLPVTLGQPASISCKSSQSLLDSDGKTYLNWLQQRPGQSPRRLISLVSKLDSGVPDRFSGSGSGTDFTLKISRVEAEDVGVYYCWQGTHFPGTFGGGTKVEIKGGGGSGGGGSGGGGSGGGGSEIQLVQSGAEVKKPGESLRISCKGSGFNIEDYYIHWVRQMPGKGLEWMGRIDPENDETKYGPIFQGHVTISADTSINTVYLQWSSLKASDTAMYYCAFRGGVYWGQGTTVTVSS

SEQ ID NO: 553 - protein, 246 aa, Artificial Sequence
  source: /note="Description of Artificial Sequence: Synthetic scFv sequence"
EIQLVQSGAEVKKPGATVKISCKGSGFNIEDYYIHWVQQAPGKGLEWMGRIDPENDETKYGPIFQGRVTITADTSTNTVYMELSSLRSEDTAVYYCAFRGGVYWGQGTTVTVSSGGGGSGGGGSGGGGSGGGGSDVVMTQSPLSLPVTLGQPASISCKSSQSLLDSDGKTYLNWLQQRPGQSPRRLISLVSKLDSGVPDRFSGSGSGTDFTLKISRVEAEDVGVYYCWQGTHFPGTFGGGTKVEIK

SEQ ID NO: 554 - protein, 246 aa, Artificial Sequence
  source: /note="Description of Artificial Sequence: Synthetic scFv sequence"
EIQLVQSGAEVKKPGESLRISCKGSGFNIEDYYIHWVRQMPGKGLEWMGRIDPENDETKYGPIFQGHVTISADTSINTVYLQWSSLKASDTAMYYCAFRGGVYWGQGTTVTVSSGGGGSGGGGSGGGGSGGGGSDVVMTQSPDSLAVSLGERATINCKSSQSLLDSDGKTYLNWLQQKPGQPPKRLISLVSKLDSGVPDRFSGSGSGTDFTLTISSLQAEDVAVYYCWQGTHFPGTFGGGTKVEIK

SEQ ID NO: 555 - protein, 246 aa, Artificial Sequence
  source: /note="Description of Artificial Sequence: Synthetic scFv sequence"
DVVMTQSPDSLAVSLGERATINCKSSQSLLDSDGKTYLNWLQQKPGQPPKRLISLVSKLDSGVPDRFSGSGSGTDFTLTISSLQAEDVAVYYCWQGTHFPGTFGGGTKVEIKGGGGSGGGGSGGGGSGGGGSEIQLVQSGAEVKKPGESLRISCKGSGFNIEDYYIHWVRQMPGKGLEWMGRIDPENDETKYGPIFQGHVTISADTSINTVYLQWSSLKASDTAMYYCAFRGGVYWGQGTTVTVSS

SEQ ID NO: 556 - protein, 246 aa, Artificial Sequence
  source: /note="Description of Artificial Sequence: Synthetic scFv sequence"
DVVMTQSPLSLPVTLGQPASISCKSSQSLLDSDGKTYLNWLQQRPGQSPRRLISLVSKLDSGVPDRFSGSGSGTDFTLKISRVEAEDVGVYYCWQGTHFPGTFGGGTKVEIKGGGGSGGGGSGGGGSGGGGSEIQLVQSGAEVKKPGATVKISCKGSGFNIEDYYIHWVQQAPGKGLEWMGRIDPENDETKYGPIFQGRVTITADTSTNTVYMELSSLRSEDTAVYYCAFRGGVYWGQGTTVTVSS

SEQ ID NO: 557 - protein, 246 aa, Artificial Sequence
  source: /note="Description of Artificial Sequence: Synthetic scFv sequence"
EIQLVQSGAEVKKPGATVKISCKGSGFNIEDYYIHWVQQAPGKGLEWMGRIDPENDETKYGPIFQGRVTITADTSTNTVYMELSSLRSEDTAVYYCAFRGGVYWGQGTTVTVSSGGGGSGGGGSGGGGSGGGGSDVVMTQSPDSLAVSLGERATINCKSSQSLLDSDGKTYLNWLQQKPGQPPKRLISLVSKLDSGVPDRFSGSGSGTDFTLTISSLQAEDVAVYYCWQGTHFPGTFGGGTKVEIK

SEQ ID NO: 558 - protein, 262 aa, Artificial Sequence
  source: /note="Description of Artificial Sequence: Synthetic scFv sequence"
MVLLVTSLLLCELPHPAFLLIPDIQMTQSPSSLSASVGDRVTITCRASQGIRNNLAWYQQKPGKAPKRLIYAASNLQSGVPSRFTGSGSGTEFTLIVSSLQPEDFATYYCLQHHSYPLTSGGGTKVEIKRTGSTSGSGKPGSGEGSEVQVLESGGGLVQPGGSLRLSCAASGFTFSSYAMSWVRQAPGKGLEWVSAISGSGGSTNYADSVKGRFTISRDNSKNTLYLQMNSLRAEDTAVYYCAGSSGWSEYWGQGTLVTVSS

SEQ ID NO: 559 - protein, 243 aa, Artificial Sequence
  source: /note="Description of Artificial Sequence: Synthetic scFv sequence"
EIQLQQSGAELVKPGASVKLSCTGSGFNIEDYYIHWVKQRTEQGLEWIGRIDPENDETKYGPIFQGRATITADTSSNTVYLQLSSLTSEDTAVYYCAFRGGVYWGPGTTLTVSSGGGGSGGGGSGGGGSHMDVVMTQSPLTLSVAIGQSASISCKSSQSLLDSDGKTYLNWLLQRPGQSPKRLISLVSKLDSGVPDRFTGSGSGTDFTLRISRVEAEDLGIYYCWQGTHFPGTFGGGTKLEIK

SEQ ID NO: 560 - protein, 240 aa, Artificial Sequence
  source: /note="Description of Artificial Sequence: Synthetic scFv sequence"
MKYLLPTAAAGLLLLAASGAHAQVQLVQSGGGLVKPGGSLRLSCAASGFTFSSYSMNWVRQAPGKGLEWVANIKPDGSERHSVDSVKGRFTISRDNSKNSLYLQMNSLRAEDTAVYYCARPGAGRLDYWGQGTLVTVSSGGGGSGGGGSGGGGSNFMLTQDAAVSVALGQTVRITCQGDSLRSYYASWYQQKPGQAPVLVVYGKNNRPSGIPDRFSGSSSGNTASLTITGAQAEDEADYY

SEQ ID NO: 561 - protein, 248 aa, Artificial Sequence
  source: /note="Description of Artificial Sequence: Synthetic scFv sequence"
QVQLQESGGGLVKPGGSLRLSCAASGFTFSSYWMSWVRQAPGKGLEWVANINRDGSASYYVDSVKGRFTISRDDAKNSLYLQMNSLRAEDTAVYYCARDRGVGYFDLWGRGTLVTVSSASTGGGGSGGGGSGGGGSQSALTQPASVSGSPGQSITISCTGTSSDVGGYNFVSWYQQHPGKAPKLMIYDVSDRPSGVSDRFSGSKSGNTASLIISGLQADDEADYYCSSYGSSSTHVIFGGGTKVTVLG

SEQ ID NO: 562 - protein, 246 aa, Artificial Sequence
  source: /note="Description of Artificial Sequence: Synthetic scFv sequence"
QVQLVESGGGLVQPGGSLRLSCAASGFTFRSYAMSWVRQAPGKGLEWVSAISGRGDNTYYADSVKGRFTISRDNSKNTLYLQMNSLRAEDTAVYYCAKMTSNAFAFDYWGQGTLVTVSSGGGGSGGGGSGGGGSQSVLTQPPSVSGAPGQRVTISCTGSSSNIGAGYGVHWYQQLPGTAPKLLIYGNTNRPSGVPDRFSGFKSGTSASLAITGLQAEDEADYYCQSYDSSLSGWVFGGGTKLTVLG

SEQ ID NO: 563 - protein, 255 aa, Artificial Sequence
  source: /note="Description of Artificial Sequence: Synthetic scFv sequence"
QVQLVQSGAEVKKPGESLKISCKGSGYSFTSYWIAWVRQMPGKGLEYMGLIYPGDSDTKYSPSFQGQVTISVDKSVSTAYLQWSSLKPSDSAVYFCARHDVGYCTDRTCAKWPEWLGVWGQGTLVTVSSGGGGSSGGGSGGGGSQSVLTQPPSVSAAPGQKVTISCSGSSSNIGNNYVSWYQQLPGTAPKLLIYDHTNRPAGVPDRFSGSKSGTSASLAISGFRSEDEADYYCASWDYTLSGWVFGGGTKLTVLG

SEQ ID NO: 564 - protein, 242 aa, Artificial Sequence
  source: /note="Description of Artificial Sequence: Synthetic scFv sequence"
QVQLVESGGGLVQPGGSLRLSCAASGFTFSSYAMGWVRQAPGKGLEWVSSISGSSRYIYYADSVKGRFTISRDNSKNTLYLQMNSLRAEDTAVYYCAKMDASGSYFNFWGQGTLVTVSSGGGGSGGGGSGGGGSETTLTQSPSFLSAFVGDRITITCRASPGIRNYLAWYQQKPGKAPKLLIYAASTLQSGVPSRFSGSGSGTDFTLTISSLQPEDFATYYCQQYNSYPLSFGGGTKVEIKR

SEQ ID NO: 565 - protein, 241 aa, Artificial Sequence
  source: /note="Description of Artificial Sequence: Synthetic scFv sequence"
EVQLLESGGGLVQPGGSLRLSCAASGFTFSSYAMSWVRQAPGKGLEWVSQIDPWGQETLYADSVKGRFTISRDNSKNTLYLQMNSLRAEDTAVYYCAKLTGRFDYWGQGTLVTVSSGGGGSGGGGSGGGGSTDIQMTQSPSSLSASVGDRVTITCRASQSISSYLNWYQQKPGKAPKLLIYSASQLQSGVPSRFSGSGSGTDFTLTISSLQPEDFATYYCQQGPGTPNTFGQGTKVEIKRA

SEQ ID NO: 566 - protein, 247 aa, Artificial Sequence
  source: /note="Description of Artificial Sequence: Synthetic scFv sequence"
DIQMTQSPSSLSASVGDRVTITCRASQSISSYLNWYQQKPGKAPKLLIYAASSLQSGVPSRFSGSGSGTDFTLTISSLQPEDFATYYCQQSYSTPFTFGPGTKVDIKRSRGGGGSGGGGSGGGGSLEMAEVQLVQSGAEVKKPGSSVKVSCKASGGTFSSYAISWVRQAPGQGLEWMGGIIPIFGTANYAQKFQGRVTITADESTSTAYMELSSLRSEDTAMYYCARYWGYDSYDEWGQGTLVTVSS

SEQ ID NO: 567 - protein, 272 aa, Artificial Sequence
  source: /note="Description of Artificial Sequence: Synthetic scFv sequence"
DIQMTQSPSSLSASVGDRVTITCRASQSISSYLNWYQQKPGKAPKLLIYAASSLQSGVPSRFSGSGSGTDFTLTISSLQPEDFATYYCQQSYSTPFTFGPGTKVDIKRSRGGGGSGGGGSGGGGSLEMAEVQLVQSGAEVKKPGSSVKVSCKASGGTFSSYAISWVRQAPGQGLEWMGGIIPIFGTANYAQKFQGRVTITADESTSTAYMELSSLRSEDTAMYYCARYWGYDSYDEWGQGTLVTVSSTSGQAGQHHHHHHGAYPYDVPDYAS

SEQ ID NO: 568 - protein, 253 aa, Artificial Sequence
  source: /note="Description of Artificial Sequence: Synthetic scFv sequence"
DVVMTQSPPSLSVTPGEPASITCRSSQSLLERNAYNYLDWYLQRPGQSPQLLIYLGSNRAAGVPDRFSGSGSGRDFTLKISRVEPEDVGVYYCMQALQAPFTFGGGTKVEIKRSRGGGGSGGGGSGGGGSLEMAEVQLVQSGGGLVQPGGSLRLSCAASGFTFSSYAMSWVRQAPGKGLEWVSAISGSGGSTYYADSVKGRFTISRDNSKNTLYLQMNSLRAEDTAVYYCAKWGPFQDAFDIWGQGTMVTVSS

SEQ ID NO: 569 - protein, 278 aa, Artificial Sequence
  source: /note="Description of Artificial Sequence: Synthetic scFv sequence"
DVVMTQSPPSLSVTPGEPASITCRSSQSLLERNAYNYLDWYLQRPGQSPQLLIYLGSNRAAGVPDRFSGSGSGRDFTLKISRVEPEDVGVYYCMQALQAPFTFGGGTKVEIKRSRGGGGSGGGGSGGGGSLEMAEVQLVQSGGGLVQPGGSLRLSCAASGFTFSSYAMSWVRQAPGKGLEWVSAISGSGGSTYYADSVKGRFTISRDNSKNTLYLQMNSLRAEDTAVYYCAKWGPFQDAFDIWGQGTMVTVSSTSGQAGQHHHHHHGAYPYDVPDYAS

SEQ ID NO: 570 - protein, 254 aa, Artificial Sequence
  source: /note="Description of Artificial Sequence: Synthetic scFv sequence"
LPVLTQPPSASATPGQRVTISCSGTTSNIGSNTVHWYQQLPGTAPKLLIYNNNQRPSGVPDRFSGSKSGTSASLAISGLRSEDEATYSCATWDDSLSGVVFGGGTKLTVLGSRGGGGSGGGGSGGGGSLEMAEVQLVQSGAEVKKPGSSVKVSCKASGGTFSSYAISWVRQAPGQGLEWMGGIIPIFGTANYAQKFQGRVTITADESTSTAYMELSSLRSEDTAVYYCARDPAYGDYEYDAFDRGQGTMVTVSS

SEQ ID NO: 571 - protein, 280 aa, Artificial Sequence
  source: /note="Description of Artificial Sequence: Synthetic scFv sequence"
LPVLTQPPSASATPGQRVTISCSGTTSNIGSNTVHWYQQLPGTAPKLLIYNNNQRPSGVPDRFSGSKSGTSASLAISGLRSEDEATYSCATWDDSLSGVVFGGGTKLTVLGSRGGGGSGGGGSGGGGSLEMAEVQLVQSGAEVKKPGSSVKVSCKASGGTFSSYAISWVRQAPGQGLEWMGGIIPIFGTANYAQKFQGRVTITADESTSTAYMELSSLRSEDTAVYYCARDPAYGDYEYDAFDRVGQGTMVTVSSTSGQAGQHHHHHHGAYPYDVPDYAS

SEQ ID NO: 572 - protein, 251 aa, Artificial Sequence
  source: /note="Description of Artificial Sequence: Synthetic scFv sequence"
LPVLTQPPSASGTPGQRVTISCSGSSSNVGSYTVNWYRQLPGTAPTLLIYNNNQRPSGVPDRFSDSKSGTSASLTISGLQPEDEADYYCAAWDDRLGGYVFGTGTKVTVLGSRGGGGSGGGGSGGGGSLEMAEVQLVQSGAEVKKPGESLKISCKGSGYSFTNYWIGWVRQMPGKGLEWMGIIYPGDSDTRYSPSFQGQVTISADKSISTAYLQWSSLKASDTAMYYCARSTGSSHMSDEWGQGTLVTVSS

SEQ ID NO: 573 - protein, 276 aa, Artificial Sequence
  source: /note="Description of Artificial Sequence: Synthetic scFv sequence"
LPVLTQPPSASGTPGQRVTISCSGSSSNVGSYTVNWYRQLPGTAPTLLIYNNNQRPSGVPDRFSDSKSGTSASLTISGLQPEDEADYYCAAWDDRLGGYVFGTGTKVTVLGSRGGGGSGGGGSGGGGSLEMAEVQLVQSGAEVKKPGESLKISCKGSGYSFTNYWIGWVRQMPGKGLEWMGIIYPGDSDTRYSPSFQGQVTISADKSISTAYLQWSSLKASDTAMYYCARSTGSSHMSDEWGQGTLVTVSSTSGQAGQHHHHHHGAYPYDVPDYAS

SEQ ID NO: 574 - protein, 264 aa, Artificial Sequence
  source: /note="Description of Artificial Sequence: Synthetic scFv sequence"
LPVLTQPPSASGTPGQRVTISCSGTSSNIGSNSVDWYQQLPGTAPKLLIYSNNQRPSGVPDRISGSKSGTSASLAISGLQSEDEADYYCAAWDDSLNGYVFGTGTKVTVLGSRGGGGSGGGGSGGGGSLEMAEVQLVQSGAEVKKPGASVKVSCKASGYTFTGYYMHWVRQAPGQGLEWMGWINPNSGGTNYAQKFQGRVTMTRDTSISTAYMELSRLRSDDTAVYYCARDYGYYGSGSYSSGPLYYYYGMDVWGQGTTVTVSS

SEQ ID NO: 575 - protein, 289 aa, Artificial Sequence
  source: /note="Description of Artificial Sequence: Synthetic scFv sequence"
LPVLTQPPSASGTPGQRVTISCSGTSSNIGSNSVDWYQQLPGTAPKLLIYSNNQRPSGVPDRISGSKSGTSASLAISGLQSEDEADYYCAAWDDSLNGYVFGTGTKVTVLGSRGGGGSGGGGSGGGGSLEMAEVQLVQSGAEVKKPGASVKVSCKASGYTFTGYYMHWVRQAPGQGLEWMGWINPNSGGTNYAQKFQGRVTMTRDTSISTAYMELSRLRSDDTAVYYCARDYGYYGSGSYSSGPLYYYYGMDVWGQGTTVTVSSTSGQAGQHHHHHHGAYPYDVPDYAS

SEQ ID NO: 576 - protein, 249 aa, Artificial Sequence
  source: /note="Description of Artificial Sequence: Synthetic scFv sequence"
LPVLTQPPSVSVAPGKTARITCGGNNIGSKSVHWYQQKPGQAPVLVVYADSDRPSGIPERFSGSNSGNTATLTISRVEAGDEADYYCQVWDSSSYHNYVFGTGTKVTVLGSRGGGGSGGGGSGGGGSLEMAEVQLVQSGAEVKKPGASVKVSCKASGYTFTSYGISWVRQAPGQGLEWMGWISAYNGNTNYAQKLQGRVTMTTDTSTSTAYMELSSLRSEDTAMYYCARYWGFGVSDRWGQGTLVTVSS

SEQ ID NO: 577 - protein, 274 aa, Artificial Sequence
  source: /note="Description of Artificial Sequence: Synthetic scFv sequence"
LPVLTQPPSVSVAPGKTARITCGGNNIGSKSVHWYQQKPGQAPVLVVYADSDRPSGIPERFSGSNSGNTATLTISRVEAGDEADYYCQVWDSSSYHNYVFGTGTKVTVLGSRGGGGSGGGGSGGGGSLEMAEVQLVQSGAEVKKPGASVKVSCKASGYTFTSYGISWVRQAPGQGLEWMGWISAYNGNTNYAQKLQGRVTMTTDTSTSTAYMELSSLRSEDTAMYYCARYWGFGVSDRWGQGTLVTVSSTSGQAGQHHHHHHGAYPYDVPDYAS

SEQ ID NO: 578 - protein, 250 aa, Artificial Sequence
  source: /note="Description of Artificial Sequence: Synthetic scFv sequence"
LPVLTQPPSVSVSPGQTAIITCSGDKLGEKYVSWYQQKPGQSPVLVIDQDTRRPSGIPERFSGSNSGTTATLTISGTQAMDEADYYCQAWDRGVVFGGGTKLTVLGSRGGGGSGGGGSGGGGSLEMAEVQLVESGGDLVQPGRSLRLSCAASGFTFNDYAMHWVRQAPGKGLEWVSGISWSGNNIGYADSVKGRFTISRDNAKNSLYLQMNSLRAEDTALYYCAKDSIRYGITWGGFDYWGQGTLVTVSS

SEQ ID NO: 579 - protein, 275 aa, Artificial Sequence
  source: /note="Description of Artificial Sequence: Synthetic scFv sequence"
LPVLTQPPSVSVSPGQTAIITCSGDKLGEKYVSWYQQKPGQSPVLVIDQDTRRPSGIPERFSGSNSGTTATLTISGTQAMDEADYYCQAWDRGVVFGGGTKLTVLGSRGGGGSGGGGSGGGGSLEMAEVQLVESGGDLVQPGRSLRLSCAASGFTFNDYAMHWVRQAPGKGLEWVSGISWSGNNIGYADSVKGRFTISRDNAKNSLYLQMNSLRAEDTALYYCAKDSIRYGITWGGFDYWGQGTLVTVSSTSGQAGQHHHHHHGAYPYDVPDYAS

SEQ ID NO: 580 - protein, 251 aa, Artificial Sequence
  source: /note="Description of Artificial Sequence: Synthetic scFv sequence"
NFMLTQPHAVSESPGKTVTISCTRSSGSIASNYVQWYQQRPGSSPRTVIYEDNQRPSGVPGRFSGSIDSSSNSASLTISGLKTEDEADYYCQSYDSTSVLFGGGTKLTVLGSRGGGGSGGGGSGGGGSLEMAEVQLVQSGAEVKKPGSSVKVSCKASGGTFSSNSLSWVRQAPGQGLEWMGRIFPILGITNYAQKFQGRVTITADKSTSTAYMELSSLRSEDTAVYYCARGNYQWYDAFDVGQGTMVTVSS

SEQ ID NO: 581 - protein, 276 aa, Artificial Sequence
  source: /note="Description of Artificial Sequence: Synthetic scFv sequence"
NFMLTQPHAVSESPGKTVTISCTRSSGSIASNYVQWYQQRPGSSPRTVIYEDNQRPSGVPGRFSGSIDSSSNSASLTISGLKTEDEADYYCQSYDSTSVLFGGGTKLTVLGSRGGGGSGGGGSGGGGSLEMAEVQLVQSGAEVKKPGSSVKVSCKASGGTFSSNSLSWVRQAPGQGLEWMGRIFPILGITNYAQKFQGRVTITADKSTSTAYMELSSLRSEDTAVYYCARGNYQWYDAFDVGQGTMVTVSSTSGQAGQHHHHHHGAYPYDVPDYAS

SEQ ID NO: 582 - protein, 254 aa, Artificial Sequence
  source: /note="Description of Artificial Sequence: Synthetic scFv sequence"
NFMLTQPHSVSESPGKTVTISCTGSSDSIANNYVQWYQQRPGSAPTNVIYEDVQRPSGVPDRFSGSIDSSSNSASLTISGLKTEDEAVYYCQSYHSDNRWVFGGGTKLTVLGSRGGGGSGGGGSGGGGSLEMAQVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCARSGAYWDYSVYDEWGQGTLVTVSS

SEQ ID NO: 583 - protein, 279 aa, Artificial Sequence
  source: /note="Description of Artificial Sequence: Synthetic scFv sequence"
NFMLTQPHSVSESPGKTVTISCTGSSDSIANNYVQWYQQRPGSAPTNVIYEDVQRPSGVPDRFSGSIDSSSNSASLTISGLKTEDEAVYYCQSYHSDNRWVFGGGTKLTVLGSRGGGGSGGGGSGGGGSLEMAQVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCARSGAYWDYSVYDEWGQGTLVTVSSTSGQAGQHHHHHHGAYPYDVPDYAS

SEQ ID NO: 584 - protein, 248 aa, Artificial Sequence
  source: /note="Description of Artificial Sequence: Synthetic scFv sequence"
NFMLTQPHSVSESPGKTVTISCTGSSGSIASNYVQWYQQRPGSAPTTVIYEDNQRPSGVPDRFSGSIDSSSNSASLTISGLKTEDEADYYCQSYDSSNHWVFGGGTKLTVLGSRGGGGSGGGGSGGGGSLEMAQVQLQQWGAGLLKPSETLSLTCAVYGGSFSGYYWSWIRQPPGKGLEWIGEITHSGRSNYNPSLKSRVTISVDTSKNQFSLKLSSVTAADTAVYYCARSSIMSDYWGQGTLVTVSS

SEQ ID NO: 585 - protein, 273 aa, Artificial Sequence
  source: /note="Description of Artificial Sequence: Synthetic scFv sequence"
NFMLTQPHSVSESPGKTVTISCTGSSGSIASNYVQWYQQRPGSAPTTVIYEDNQRPSGVPDRFSGSIDSSSNSASLTISGLKTEDEADYYCQSYDSSNHWVFGGGTKLTVLGSRGGGGSGGGGSGGGGSLEMAQVQLQQWGAGLLKPSETLSLTCAVYGGSFSGYYWSWIRQPPGKGLEWIGEITHSGRSNYNPSLKSRVTISVDTSKNQFSLKLSSVTAADTAVYYCARSSIMSDYWGQGTLVTVSSTSGQAGQHHHHHHGAYPYDVPDYAS

SEQ ID NO: 586 - protein, 250 aa, Artificial Sequence
  source: /note="Description of Artificial Sequence: Synthetic scFv sequence"
NFMLTQPHSVSESPGKTVTISCTGSSGSIASNYVQWYQQRPGSAPTTVIYEDNQRPSGVPDRFSGSIDSSSNSASLTISGLKTEDEADYYCQSYDSSNLWVFGGGTKLTVLGSRGGGGSGGGGSGGGGSLEMAQMQLVQSGAEVKKPGSSVKVSCKASGGTFSSYAISWVRQAPGQGLEWMGGIIPIFGTANYAQKFQGRVTITADESTSTAYMELSSLRSEDTAVYYCARYNYYYYDSWGQGTLVTVSS

SEQ ID NO: 587 - protein, 275 aa, Artificial Sequence
  source: /note="Description of Artificial Sequence: Synthetic scFv sequence"
NFMLTQPHSVSESPGKTVTISCTGSSGSIASNYVQWYQQRPGSAPTTVIYEDNQRPSGVPDRFSGSIDSSSNSASLTISGLKTEDEADYYCQSYDSSNLWVFGGGTKLTVLGSRGGGGSGGGGSGGGGSLEMAQMQLVQSGAEVKKPGSSVKVSCKASGGTFSSYAISWVRQAPGQGLEWMGGIIPIFGTANYAQKFQGRVTITADESTSTAYMELSSLRSEDTAVYYCARYNYYYYDSWGQGTLVTVSSTSGQAGQHHHHHHGAYPYDVPDYAS

SEQ ID NO: 588 - protein, 249 aa, Artificial Sequence
  source: /note="Description of Artificial Sequence: Synthetic scFv sequence"
NFMLTQPHSVSESPGKTVTISCTGSSGSIASNYVQWYQQRPGSAPTTVIYEDNQRPSGVPDRFSGSIDSSSNSASLTISGLKTEDEADYYCQSYDSSNWVFGGGTKLTVLGSRGGGGSGGGGSGGGGSLEMAEVQLVQSGAEVKKPGSSVKVSCKASGGTFSSYAISWVRQAPGQGLEWMGGIIPIFGTANYAQKFQGRVTITADESTSTAYMELSSLRSEDTAVYYCARNNHYYNDYWGQGTLVTVSS

SEQ ID NO: 589 - protein, 274 aa, Artificial Sequence
  source: /note="Description of Artificial Sequence: Synthetic scFv sequence"
NFMLTQPHSVSESPGKTVTISCTGSSGSIASNYVQWYQQRPGSAPTTVIYEDNQRPSGVPDRFSGSIDSSSNSASLTISGLKTEDEADYYCQSYDSSNWVFGGGTKLTVLGSRGGGGSGGGGSGGGGSLEMAEVQLVQSGAEVKKPGSSVKVSCKASGGTFSSYAISWVRQAPGQGLEWMGGIIPIFGTANYAQKFQGRVTITADESTSTAYMELSSLRSEDTAVYYCARNNHYYNDYWGQGTLVTVSSTSGQAGQHHHHHHGAYPYDVPDYAS

SEQ ID NO: 590 - protein, 248 aa, Artificial Sequence
  source: /note="Description of Artificial Sequence: Synthetic scFv sequence"
NFMLTQPHSVSESPGKTVTISCTRSSGSIASNFVQWYQQRPGSAPTPMIYEDNNRPPGVPDRFSASVDSSSNSASLTISGLKTEDEADYYCQSYDTSNVVFGGGTKLTVLGSRGGGGSGGGGSGGGGSLEMAEVQLVESGGGLVQPGGSLRLSCAASGFTFSSYEMNWVRQAPGKGLEWVSYISSSGSTIYYADSVKGRFTISRDNAKNSLYLQMNSLRAEDTAVYYCARWDYGMDVWGQGTTVTVSS

SEQ ID NO: 591 - protein, 273 aa, Artificial Sequence
  source: /note="Description of Artificial Sequence: Synthetic scFv sequence"
NFMLTQPHSVSESPGKTVTISCTRSSGSIASNFVQWYQQRPGSAPTPMIYEDNNRPPGVPDRFSASVDSSSNSASLTISGLKTEDEADYYCQSYDTSNVVFGGGTKLTVLGSRGGGGSGGGGSGGGGSLEMAEVQLVESGGGLVQPGGSLRLSCAASGFTFSSYEMNWVRQAPGKGLEWVSYISSSGSTIYYADSVKGRFTISRDNAKNSLYLQMNSLRAEDTAVYYCARWDYGMDVWGQGTTVTVSSTSGQAGQHHHHHHGAYPYDVPDYAS

SEQ ID NO: 592 - protein, 249 aa, Artificial Sequence
  source: /note="Description of Artificial Sequence: Synthetic scFv sequence"
NFMLTQPHSVSESPGKTVTISCTRSSGSIASNYVQWYQQRPGSAPTTVIYEDNQRPSGVPDRFSGSIDSSSNSASLTISGLKTEDEADYYCQSYDSSNSVVFGGGTKLTVLGSRGGGGSGGGGSGGGGSLEMAQVQLVQSGTEVKKPGASVRVACKASGYPFNKYDINWVRQAPGQGLEWMGGIIPIFRTTNYAQKFQGRVTITADESTSTAYMELSSLRSEDTAVYYCAREWFYWDIWGQGTLVTVSS

SEQ ID NO: 593 - protein, 274 aa, Artificial Sequence
  source: /note="Description of Artificial Sequence: Synthetic scFv sequence"
NFMLTQPHSVSESPGKTVTISCTRSSGSIASNYVQWYQQRPGSAPTTVIYEDNQRPSGVPDRFSGSIDSSSNSASLTISGLKTEDEADYYCQSYDSSNSVVFGGGTKLTVLGSRGGGGSGGGGSGGGGSLEMAQVQLVQSGTEVKKPGASVRVACKASGYPFNKYDINWVRQAPGQGLEWMGGIIPIFRTTNYAQKFQGRVTITADESTSTAYMELSSLRSEDTAVYYCAREWFYWDIWGQGTLVTVSSTSGQAGQHHHHHHGAYPYDVPDYAS

SEQ ID NO: 594 - protein, 265 aa, Artificial Sequence
  source: /note="Description of Artificial Sequence: Synthetic scFv sequence"
NFMLTQPHSVSESPGKTVTISCTRSSGSIASNYVQWYQQRPGSAPTTVIYEDNQRPSGVPDRFSGSIDSSSNSASLTISGLKTEDEADYYCQSYDSSNSWVFGGGTKLTVLGSRGGGGSGGGGSGGGGSLEMAQVQLVQSGAEVKRPGSSVKVSCTASGGTFSSDAISWVRQAPGQGLEWMGGIIPMFGTANYAQKFQGRVTITADESTSTAYMELSSLRSEDTAVYYCAREGYYYPSAYLGSVLNDISSVYDEWGQGTLVTVSS

SEQ ID NO: 595 - protein, 290 aa, Artificial Sequence
  source: /note="Description of Artificial Sequence: Synthetic scFv sequence"
NFMLTQPHSVSESPGKTVTISCTRSSGSIASNYVQWYQQRPGSAPTTVIYEDNQRPSGVPDRFSGSIDSSSNSASLTISGLKTEDEADYYCQSYDSSNSWVFGGGTKLTVLGSRGGGGSGGGGSGGGGSLEMAQVQLVQSGAEVKRPGSSVKVSCTASGGTFSSDAISWVRQAPGQGLEWMGGIIPMFGTANYAQKFQGRVTITADESTSTAYMELSSLRSEDTAVYYCAREGYYYPSAYLGSVLNDISSVYDEWGQGTLVTVSSTSGQAGQHHHHHHGAYPYDVPDYAS

SEQ ID NO: 596 - protein, 273 aa, Artificial Sequence
  source: /note="Description of Artificial Sequence: Synthetic scFv sequence"
NFMLTQPHSVSESPGKTVTISCTRSSGSIASNYVQWYQQRPGSAPTTVIYEDNQRPSGVPDRFSGSIDSSSNSASLTISGLKTEDEADYYCQSYDSSNVVFGGGTKVTVLGSRGGGGSGGGGSGGGGSLEMAEVQLVESGGGLVQPGGSLRLSCAASGFTFSSYEMNWVRQAPGKGLEWVSYISSSGSTIYYADSVKGRFTISRDNAKNSLYLQMNSLRAEDTAVYYCARWDYGMDVWGQGTTVTVSSTSGQAGQHHHHHHGAYPYDVPDYAS

SEQ ID NO: 597 - protein, 249 aa, Artificial Sequence
  source: /note="Description of Artificial Sequence: Synthetic scFv sequence"
NFMLTQPHSVSESPGKTVTISCTRSSGSIASNYVQWYQQRPGSAPTTVIYEDNQRPSGVPDRFSGSIDSSSNSASLTISGLKTEDEADYYCQSYDSTNWVFGGGTKLTVLGSRGGGGSGGGGSGGGGSLEMAQVQLVQSGAEVKKPGSSVKVSCKASGGTFSSYAISWVRQAPGQGLEWMGGIIPIFGTANYAQKFQGRVTITADESTSTAYMELSSLRSEDTAVYYCARYNYYFNDYWGQGTLVTVSS

SEQ ID NO: 598 - protein, 274 aa, Artificial Sequence
  source: /note="Description of Artificial Sequence: Synthetic scFv sequence"
NFMLTQPHSVSESPGKTVTISCTRSSGSIASNYVQWYQQRPGSAPTTVIYEDNQRPSGVPDRFSGSIDSSSNSASLTISGLKTEDEADYYCQSYDSTNWVFGGGTKLTVLGSRGGGGSGGGGSGGGGSLEMAQVQLVQSGAEVKKPGSSVKVSCKASGGTFSSYAISWVRQAPGQGLEWMGGIIPIFGTANYAQKFQGRVTITADESTSTAYMELSSLRSEDTAVYYCARYNYYFNDYWGQGTLVTVSSTSGQAGQHHHHHHGAYPYDVPDYAS

SEQ ID NO: 599 - protein, 249 aa, Artificial Sequence
  source: /note="Description of Artificial Sequence: Synthetic scFv sequence"
NFMLTQPHSVSESPGKTVTISCTRSSGSIASNYVQWYQQRPGSSPTTVIYEDNQRPSGVPDRFSGSIDSSSNSASLTISGLKTEDEADYYCQSYDSSNWVFGGGTKLTVLGSRGGGGSGGGGSGGGGSLEMAEVQLVQSGAEVKKPGSSVKVSCKASGGTFSSYAISWVRQAPGQGLEWMGGIIPIFGTANYAQKFQGRVTITADESTSTAYMELSSLRSEDTAVYYCARSNYYYNDYWGQGTLVTVSS

SEQ ID NO: 600 - protein, 274 aa, Artificial Sequence
  source: /note="Description of Artificial Sequence: Synthetic scFv sequence"
NFMLTQPHSVSESPGKTVTISCTRSSGSIASNYVQWYQQRPGSSPTTVIYEDNQRPSGVPDRFSGSIDSSSNSASLTISGLKTEDEADYYCQSYDSSNWVFGGGTKLTVLGSRGGGGSGGGGSGGGGSLEMAEVQLVQSGAEVKKPGSSVKVSCKASGGTFSSYAISWVRQAPGQGLEWMGGIIPIFGTANYAQKFQGRVTITADESTSTAYMELSSLRSEDTAVYYCARSNYYYNDYWGQGTLVTVSSTSGQAGQHHHHHHGAYPYDVPDYAS

SEQ ID NO: 601 - protein, 249 aa, Artificial Sequence
  source: /note="Description of Artificial Sequence: Synthetic scFv sequence"
NFMLTQPHSVSGSPGKTVTISCTGSSGSIADNFVQWYQQRPGGVPTTVIFNDDERPSGVPDRFSGSIDTSSNSASLTISGLKTEDEADYYCQSYDNNNRGVFGGGTKLTVLGSRGGGGSGGGGSGGGGSLEMAQVQLVQSGAEVKKPGSSVKVSCKASGGTFSSYAISWVRQAPGQGLEWMGWMNPNSGNTGYAQKFQGRVTMTRNTSISTAYMELSNLRSEDTAVYYCARYYSYGYDWGQGTLVTVSS

SEQ ID NO: 602 - protein, 274 aa, Artificial Sequence
  source: /note="Description of Artificial Sequence: Synthetic scFv sequence"
NFMLTQPHSVSGSPGKTVTISCTGSSGSIADNFVQWYQQRPGGVPTTVIFNDDERPSGVPDRFSGSIDTSSNSASLTISGLKTEDEADYYCQSYDNNNRGVFGGGTKLTVLGSRGGGGSGGGGSGGGGSLEMAQVQLVQSGAEVKKPGSSVKVSCKASGGTFSSYAISWVRQAPGQGLEWMGWMNPNSGNTGYAQKFQGRVTMTRNTSISTAYMELSNLRSEDTAVYYCARYYSYGYDWGQGTLVTVSSTSGQAGQHHHHHHGAYPYDVPDYAS

SEQ ID NO: 603 - protein, 256 aa, Artificial Sequence
  source: /note="Description of Artificial Sequence: Synthetic scFv sequence"
QAVLTQPASVSGSPGQSITISCTGTSSDVGGYNYVSWYQQHPGKAPKLMIYEVSNRPSGVSNRFSGSKSGNTASLTISGLQAEDEADYYCSSYTSSSTPYVFGAGTKVTVLGSRGGGGSGGGGSGGGGSLEMAEVQLVESGGGLVQPGRSLRLSCAASGFTFDDYAMHWVRQAPGKGLEWVSGISWNSGSIGYADSVKGRFTISRDNAKNSLYLQMNSLRAEDTALYYCAKARWTAVASDHHFDYWGQGTLVTVSS

SEQ ID NO: 604 - protein, 281 aa, Artificial Sequence
  source: /note="Description of Artificial Sequence: Synthetic scFv sequence"
QAVLTQPASVSGSPGQSITISCTGTSSDVGGYNYVSWYQQHPGKAPKLMIYEVSNRPSGVSNRFSGSKSGNTASLTISGLQAEDEADYYCSSYTSSSTPYVFGAGTKVTVLGSRGGGGSGGGGSGGGGSLEMAEVQLVESGGGLVQPGRSLRLSCAASGFTFDDYAMHWVRQAPGKGLEWVSGISWNSGSIGYADSVKGRFTISRDNAKNSLYLQMNSLRAEDTALYYCAKARWTAVASDHHFDYWGQGTLVTVSSTSGQAGQHHHHHHGAYPYDVPDYAS

SEQ ID NO: 605 - protein, 257 aa, Artificial Sequence
  source: /note="Description of Artificial Sequence: Synthetic scFv sequence"
QAVLTQPHSVSESPGKTVTISCTRSSGSIASNYVQWYQQRPGSAPTTVIYEDNQRPSGVPDRFSGSIDSSSNSASLTISGLKTEDEADYYCQSYDSTITVFGGGTKLTVLGSRGGGGSGGGGSGGGGSLEMAQVQLVQSGAEVKKPGSSVKVSCKASGGTFSSYAISWVRQAPGQGLEWMGGIIPIFGTANYAQKFQGRVTITADESTSTAYMELSSLRSEDTAVYYCAGEGYYDSSGYSNGDAFDRGQGTMVTVSS

SEQ ID NO: 606 - protein, 283 aa, Artificial Sequence
  source: /note="Description of Artificial Sequence: Synthetic scFv sequence"
QAVLTQPHSVSESPGKTVTISCTRSSGSIASNYVQWYQQRPGSAPTTVIYEDNQRPSGVPDRFSGSIDSSSNSASLTISGLKTEDEADYYCQSYDSTITVFGGGTKLTVLGSRGGGGSGGGGSGGGGSLEMAQVQLVQSGAEVKKPGSSVKVSCKASGGTFSSYAISWVRQAPGQGLEWMGGIIPIFGTANYAQKFQGRVTITADESTSTAYMELSSLRSEDTAVYYCAGEGYYDSSGYSNGDAFDRVGQGTMVTVSSTSGQAGQHHHHHHGAYPYDVPDYAS

SEQ ID NO: 607 - protein, 247 aa, Artificial Sequence
  source: /note="Description of Artificial Sequence: Synthetic scFv sequence"
QAVLTQPPSASETPGQRVTISCSGSRSNIGTNIVHWYQQRPGMAPKLLTYGSRRPSGVPDRFSGSKFGTSASLAISGLQSEDEADYYCAAWDDSLNGPAFGGGTKLTVLGSRGGGGSGGGGSGGGGSLEMAQVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARDGGGYFDYWGQGTLVTVSS

SEQ ID NO: 608 - protein, 272 aa, Artificial Sequence
  source: /note="Description of Artificial Sequence: Synthetic scFv sequence"
QAVLTQPPSASETPGQRVTISCSGSRSNIGTNIVHWYQQRPGMAPKLLTYGSRRPSGVPDRFSGSKFGTSASLAISGLQSEDEADYYCAAWDDSLNGPAFGGGTKLTVLGSRGGGGSGGGGSGGGGSLEMAQVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARDGGGYFDYWGQGTLVTVSSTSGQAGQHHHHHHGAYPYDVPDYAS

SEQ ID NO: 609 - protein, 253 aa, Artificial Sequence
  source: /note="Description of Artificial Sequence: Synthetic scFv sequence"
QAVLTQPPSASGAPGQRVTVSCSGSNSNIGSNYVNWYQQFPGTAPKLLMYSSSQRPSGVPDRFSGSKSGTSASLAISGLHSEDEADYYCATWDDSLNAWVFGGGTKLTVLGSRGGGGSGGGGSGGGGSLEMAEVQLVQSGAEVRKPGASVKVSCKTSGYTFTWYAIHWVRQAPGQRLEWMGWINAGSGNTKYSQKFQGRVTLTRDTSASTAYMELSSLRSDDTAVYYCARPNNYGSGGDVFDRGQGTMVTVSS

SEQ ID NO: 610 - protein, 278 aa, Artificial Sequence
  source: /note="Description of Artificial Sequence: Synthetic scFv sequence"
QAVLTQPPSASGAPGQRVTVSCSGSNSNIGSNYVNWYQQFPGTAPKLLMYSSSQRPSGVPDRFSGSKSGTSASLAISGLHSEDEADYYCATWDDSLNAWVFGGGTKLTVLGSRGGGGSGGGGSGGGGSLEMAEVQLVQSGAEVRKPGASVKVSCKTSGYTFTWYAIHWVRQAPGQRLEWMGWINAGSGNTKYSQKFQGRVTLTRDTSASTAYMELSSLRSDDTAVYYCARPNNYGSGGDVFDRGQGTMVTVSSTSGQAGQHHHHHHGAYPYDVPDYAS

SEQ ID NO: 611 - protein, 248 aa, Artificial Sequence
  source: /note="Description of Artificial Sequence: Synthetic scFv sequence"
QAVLTQPPSASGTPGQRVTISCSGSSSNIGSNTVNWYQQLPGTAPKLLIYSNNQRPSGVPDRFSGSKSGTSASLAISGLQSEDEADYYCAAWDDSLNGYVFGTGTKLTVLGSRGGGGSGGGGSGGGGSLEMAEVQLVQSGAEVKKPGSSVKVSCKASGGTFSSYAISWVRQAPGQGLEWMGGIIPIFGTANYAQKFQGRVTITADESTSTAYMELSSLRSEDTAVYYCARDWDYMDVWGKGTTVTVSS

SEQ ID NO: 612 - protein, 273 aa, Artificial Sequence
  source: /note="Description of Artificial Sequence: Synthetic scFv sequence"
QAVLTQPPSASGTPGQRVTISCSGSSSNIGSNTVNWYQQLPGTAPKLLIYSNNQRPSGVPDRFSGSKSGTSASLAISGLQSEDEADYYCAAWDDSLNGYVFGTGTKLTVLGSRGGGGSGGGGSGGGGSLEMAEVQLVQSGAEVKKPGSSVKVSCKASGGTFSSYAISWVRQAPGQGLEWMGGIIPIFGTANYAQKFQGRVTITADESTSTAYMELSSLRSEDTAVYYCARDWDYMDVWGKGTTVTVSSTSGQAGQHHHHHHGAYPYDVPDYAS

SEQ ID NO: 613 - protein, 248 aa, Artificial Sequence
  source: /note="Description of Artificial Sequence: Synthetic scFv sequence"
QAVLTQPPSASGTPGQRVTISCSGSSSNIGSNTVNWYQQLPGTAPKLLIYSNNQRPSGVPDRFSGSKSGTSASLAISGLQSEDETDYYCAAWDDSLNGYVFGTGTKVTVLGSRGGGGSGGGGSGGGGSLEMAQVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCAREGLDAFDIWGQGTMVTVSS

SEQ ID NO: 614 - protein, 273 aa, Artificial Sequence
  source: /note="Description of Artificial Sequence: Synthetic scFv sequence"
QAVLTQPPSASGTPGQRVTISCSGSSSNIGSNTVNWYQQLPGTAPKLLIYSNNQRPSGVPDRFSGSKSGTSASLAISGLQSEDETDYYCAAWDDSLNGYVFGTGTKVTVLGSRGGGGSGGGGSGGGGSLEMAQVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCAREGLDAFDIWGQGTMVTVSSTSGQAGQHHHHHHGAYPYDVPDYAS

SEQ ID NO: 615 - protein, 259 aa, Artificial Sequence
  source: /note="Description of Artificial Sequence: Synthetic scFv sequence"
QAVLTQPPSASGTPGQRVTISCSGSSSNIGSNTVNWYQQLPGTAPKLLMYNNDQRPSGVPDRFSGSKSGTSASLAISGLQSEDEADYYCAAWDDSLNGYVFGPGTKVTVLGSRGGGGSGGGGSGGGGSLEMAQVQLVESGAEVKKPGASVKVSCKASGYTFTSYGISWVRQAPGQGLEWMGWISAYNGNTNYAQKLQGRVTMTTDTSTSTAYMELRSLRSDDTAVYYCARDLSRGANPHYYYYYGMDVWGQGTTVTVSS

SEQ ID NO: 616 - protein, 284 aa, Artificial Sequence
  source: /note="Description of Artificial Sequence: Synthetic scFv sequence"
QAVLTQPPSASGTPGQRVTISCSGSSSNIGSNTVNWYQQLPGTAPKLLMYNNDQRPSGVPDRFSGSKSGTSASLAISGLQSEDEADYYCAAWDDSLNGYVFGPGTKVTVLGSRGGGGSGGGGSGGGGSLEMAQVQLVESGAEVKKPGASVKVSCKASGYTFTSYGISWVRQAPGQGLEWMGWISAYNGNTNYAQKLQGRVTMTTDTSTSTAYMELRSLRSDDTAVYYCARDLSRGANPHYYYYYGMDVWGQGTTVTVSSTSGQAGQHHHHHHGAYPYDVPDYAS

SEQ ID NO: 617 - protein, 247 aa, Artificial Sequence
  source: /note="Description of Artificial Sequence: Synthetic scFv sequence"
QAVLTQPPSASGTPGQRVTISCSGSSSNIGSNTVNWYQQLPGTAPKLLMYSNDQRPSGVPDRFSGSKSGTSASLAISGLQSEDEADYYCAAWDDSLNGYVFAAGTQLTVLSSRGGGGSGGGGSGGGGSLEMAQVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCAREGLDAFDRGQGTMVTVSS

SEQ ID NO: 618 - protein, 273 aa, Artificial Sequence
  source: /note="Description of Artificial Sequence: Synthetic scFv sequence"
QAVLTQPPSASGTPGQRVTISCSGSSSNIGSNTVNWYQQLPGTAPKLLMYSNDQRPSGVPDRFSGSKSGTSASLAISGLQSEDEADYYCAAWDDSLNGYVFAAGTQLTVLSSRGGGGSGGGGSGGGGSLEMAQVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCAREGLDAFDRVGQGTMVTVSSTSGQAGQHHHHHHGAYPYDVPDYAS

SEQ ID NO: 619 - protein, 247 aa, Artificial Sequence
  source: /note="Description of Artificial Sequence: Synthetic scFv sequence"
QAVLTQPPSTSGTPGQRVTISCSGSSSNIGRNGVNWYQQLPGAAPKVLIYNDNQRPSGVPDRVSGSQSGSSGTLAIDGLRSEDEADYYCAAWDDSLHGVVFGGGTKLTVLGSRGGGGSGGGGSGGGGSLEMAQVQLVQSGAEVKKPGASVKVSCKVSGYTLNELSMHWVRQAPGKGLEWMGGFDPEDGETIYAQKFQGRVTMTEDTSTDTAYMELSSLRSEDTAVYYCARGGYGDSWGQGTLVTVSS

SEQ ID NO: 620 - protein, 272 aa, Artificial Sequence
  source: /note="Description of Artificial Sequence: Synthetic scFv sequence"
QAVLTQPPSTSGTPGQRVTISCSGSSSNIGRNGVNWYQQLPGAAPKVLIYNDNQRPSGVPDRVSGSQSGSSGTLAIDGLRSEDEADYYCAAWDDSLHGVVFGGGTKLTVLGSRGGGGSGGGGSGGGGSLEMAQVQLVQSGAEVKKPGASVKVSCKVSGYTLNELSMHWVRQAPGKGLEWMGGFDPEDGETIYAQKFQGRVTMTEDTSTDTAYMELSSLRSEDTAVYYCARGGYGDSWGQGTLVTVSSTSGQAGQHHHHHHGAYPYDVPDYAS

SEQ ID NO: 621 - protein, 249 aa, Artificial Sequence
  source: /note="Description of Artificial Sequence: Synthetic scFv sequence"
QAVLTQPPSVSVAPGKTARVTCGGNNIGSESVHWYQQKPGQAPVLVIYYDTDRPSGIPERFSGSHSGTTATLTISRVEAGDEADYYCQVWDSSRDHVVFGGGTKLTVLGSRGGGGSGGGGSGGGGSLEMAQVQLVQSGGGVVQPGRSLRLSCAASGFTFSSYAMHWVRQAPGKGLEWVAVISYDGSNKYYADSVKGLFTISRDNSKNTLYLQMNSLRAEDTAVYYCARSYFTSGFYDYWGQGTLVTVSS

SEQ ID NO: 622 - protein, 274 aa, Artificial Sequence
  source: /note="Description of Artificial Sequence: Synthetic scFv sequence"
QAVLTQPPSVSVAPGKTARVTCGGNNIGSESVHWYQQKPGQAPVLVIYYDTDRPSGIPERFSGSHSGTTATLTISRVEAGDEADYYCQVWDSSRDHVVFGGGTKLTVLGSRGGGGSGGGGSGGGGSLEMAQVQLVQSGGGVVQPGRSLRLSCAASGFTFSSYAMHWVRQAPGKGLEWVAVISYDGSNKYYADSVKGLFTISRDNSKNTLYLQMNSLRAEDTAVYYCARSYFTSGFYDYWGQGTLVTVSSTSGQAGQHHHHHHGAYPYDVPDYAS

SEQ ID NO: 623 - protein, 250 aa, Artificial Sequence
  source: /note="Description of Artificial Sequence: Synthetic scFv sequence"
QPVLTQPPSVSKGLRQTATLTCTGNSNNVGNLGVAWLQQHQGHPPKLLSYRNNNRPSGISERLSASRSGNTASLTITGLQPEDEADYYCSAWDSSLSAWVFGGGTKLTVLGSRGGGGSGGGGSGGGGSLEMAEVQLVESGGVVVQPGGSLRLSCAASGFTFDDYAMHWVRQAPGKGLEWVSLINWDGGSTYYADSVKGRFTISRDNSKNSLYLQMNSLRAEDTALYYCAKGMGLRAFDYWGQGTLVTVSS

SEQ ID NO: 624 - protein, 275 aa, Artificial Sequence
  source: /note="Description of Artificial Sequence: Synthetic scFv sequence"
QPVLTQPPSVSKGLRQTATLTCTGNSNNVGNLGVAWLQQHQGHPPKLLSYRNNNRPSGISERLSASRSGNTASLTITGLQPEDEADYYCSAWDSSLSAWVFGGGTKLTVLGSRGGGGSGGGGSGGGGSLEMAEVQLVESGGVVVQPGGSLRLSCAASGFTFDDYAMHWVRQAPGKGLEWVSLINWDGGSTYYADSVKGRFTISRDNSKNSLYLQMNSLRAEDTALYYCAKGMGLRAFDYWGQGTLVTVSSTSGQAGQHHHHHHGAYPYDVPDYAS

SEQ ID NO: 625 - protein, 245 aa, Artificial Sequence
  source: /note="Description of Artificial Sequence: Synthetic scFv sequence"
QPVLTQPPSVSVAPGKTATITCGGNNIGSESVHWYHQKPGQAPVLVIYDDAGRPSGIPERFTGSNSGNTATLTISRVEAGDEADYYCQVWDRNSAQFVFGPGTKVTVLGSRGGGGSGGGGSGGGGSLEMAEVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCARGVHLDWWGQGTLVTVSS

SEQ ID NO: 626 - protein, 270 aa, Artificial Sequence
  source: /note="Description of Artificial Sequence: Synthetic scFv sequence"
QPVLTQPPSVSVAPGKTATITCGGNNIGSESVHWYHQKPGQAPVLVIYDDAGRPSGIPERFTGSNSGNTATLTISRVEAGDEADYYCQVWDRNSAQFVFGPGTKVTVLGSRGGGGSGGGGSGGGGSLEMAEVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCARGVHLDWWGQGTLVTVSSTSGQAGQHHHHHHGAYPYDVPDYAS

SEQ ID NO: 627 - protein, 250 aa, Artificial Sequence
  source: /note="Description of Artificial Sequence: Synthetic scFv sequence"
QPVLTQPPSVSVSPGQTAAIPCSGDKLGDKFASWYQQKPGQSPVLVIYQDTKRPSGIPERFSGSNSGNTATLTISGTQAMDEADYYCQTWASGRVVFGGGTKLTVLGSRGGGGSGGGGSGGGGSLEMAQVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCARERSGWKGFDYWGQGTLVTVSS

SEQ ID NO: 628 - protein, 275 aa, Artificial Sequence
  source: /note="Description of Artificial Sequence: Synthetic scFv sequence"
QPVLTQPPSVSVSPGQTAAIPCSGDKLGDKFASWYQQKPGQSPVLVIYQDTKRPSGIPERFSGSNSGNTATLTISGTQAMDEADYYCQTWASGRVVFGGGTKLTVLGSRGGGGSGGGGSGGGGSLEMAQVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCARERSGWKGFDYWGQGTLVTVSSTSGQAGQHHHHHHGAYPYDVPDYAS

SEQ ID NO: 629 - protein, 248 aa, Artificial Sequence
  source: /note="Description of Artificial Sequence: Synthetic scFv sequence"
QPVLTQPPSVSVVPGKTARITCGGKNIGSKSVHWYQQKPGQAPVVVIHYDSDRPSGIPERFSGSNSGNTATLTISRVEAGDEADYYCQVWDSSSDHPYVFGTGTKVTVLGSRGGGGSGGGGSGGGGSLEMAQVQLVQSGAEVKKPGASVKVSCKASGYTFTNYGISWVRQAPGQGLEWMGWISAYNGNTNYAHKLQGRVTMTTDTSTSTANMELRSLRPDDTAVYYCARSYFGSHDYWGQGTLVTVSS

SEQ ID NO: 630 - protein, 273 aa, Artificial Sequence
  source: /note="Description of Artificial Sequence: Synthetic scFv sequence"
QPVLTQPPSVSVVPGKTARITCGGKNIGSKSVHWYQQKPGQAPVVVIHYDSDRPSGIPERFSGSNSGNTATLTISRVEAGDEADYYCQVWDSSSDHPYVFGTGTKVTVLGSRGGGGSGGGGSGGGGSLEMAQVQLVQSGAEVKKPGASVKVSCKASGYTFTNYGISWVRQAPGQGLEWMGWISAYNGNTNYAHKLQGRVTMTTDTSTSTANMELRSLRPDDTAVYYCARSYFGSHDYWGQGTLVTVSSTSGQAGQHHHHHHGAYPYDVPDYAS

SEQ ID NO: 631 - protein, 256 aa, Artificial Sequence
  source: /note="Description of Artificial Sequence: Synthetic scFv sequence"
QSALTQPASVSGSPGQSITISCTGTSSDIGGYNYVSWYQQHPGKAPKLMIYDVSNRPSGVSNRFSGSKSGNTASLTISGLQAEDEADYYCISYTRTWNPYVFGSGTKVTVLGSRGGGGSGGGGSGGGGSLEMAEVQLVQSGGGVVQPGGSLRLSCAASGFTFDDYAMHWVRQAPGKGLEWVSLISGDGGSTYYADSVKGRFTISRDNSKNSLYLQMNSLRTEDTALYYCAKDRAAAGYYYYGMDVWGQGTTVTVSS

SEQ ID NO: 632 - protein, 274 aa, Artificial Sequence
  source: /note="Description of Artificial Sequence: Synthetic scFv sequence"
QSALTQPASVSGSPGQSITISCTGTSSDVGGYNSVSWYQQHPGKAPRLMIYDVSNRPSGVSNRFSGSKSGNTASLTISGLQAEDEADYYCSSYTSSSTPLVFGTGTKVTVLGSRGGGGSGGGGSGGGGSLEMAQVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCARGAVAYHDWGQGTLVTVSSTSGQAGQHHHHHHGAYPYDVPDYAS

SEQ ID NO: 633 - protein, 279 aa, Artificial Sequence
  source: /note="Description of Artificial Sequence: Synthetic scFv sequence"
QSALTQPASVSGSPGQSMSCTGTSSDIGGYNYVSWYQQHPGKAPKLMIYDVSNRPSGVSNRFSGSKSGNTASLTISGLQAEDEADYYCISYTRTWNPYVFGSGTKVTVLGSRGGGGSGGGGSGGGGSLEMAEVQLVQSGGGVVQPGGSLRLSCAASGFTFDDYAMHWVRQAPGKGLEWVSLISGDGGSTYYADSVKGRFTISRDNSKNSLYLQMNSLRTEDTALYYCAKDRAAAGYYYYGMDVWGQGTTVTVSSTSGQAGQHHHHHHGAYPYDVPDYAS

SEQ ID NO: 634 - protein, 272 aa, Artificial Sequence
  source: /note="Description of Artificial Sequence: Synthetic scFv sequence"
QSALTQPASVSGSPGQSMSCTGTSSDVGGYNSVSWYQQHPGKAPRLMIYDVSNRPSGVSNRFSGSKSGNTASLTISGLQAEDEADYYCSSYTSSSTPLVFGTGTKVTVLGSRGGGGSGGGGSGGGGSLEMAQVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCARGAVAYHDWGQGTLVTVSSTSGQAGQHHHHHHGAYPYDVPDYAS

SEQ ID NO: 635 - protein, 276 aa, Artificial Sequence
  source: /note="Description of Artificial Sequence: Synthetic scFv sequence"
QSALTQPASVSGSPGQSMSCTGTSSDVGGYNYVSWYQQHPGKAPKLMIYDVSNRPSGVSNRFSGSKSGNTASLTISGLQAEDEADYYCSSYTSSSTSKVFGGGTKLTVLGSRGGGGSGGGGSGGGGSLEMAEVQLVESGGGVVRPGGSLRLSCAASGFTFGDYGMSWVRQAPGKGLEWVSGINWNGGSTGYADSVKGRFTISRDNAKNSLYLQMNSLRAEDTAVYYCARSKYNFHVYYDYWGQGTLVTVSSTSGQAGQHHHHHHGAYPYDVPDYAS

SEQ ID NO: 636 - protein, 249 aa, Artificial Sequence
  source: /note="Description of Artificial Sequence: Synthetic scFv sequence"
QSALTQPASVSGSPGQSRRISCTGTSSDVGGYNSVSWYQQHPGKAPRLMIYDVSNRPSGVSNRFSGSKSGNTASLTISGLQAEDEADYYCSSYTSSSTPLVFGTGTKVTVLGSRGGGGSGGGGSGGGGSLEMAQVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCARGAVAYHDWGQGTLVTVSS

SEQ ID NO: 637 - protein, 253 aa, Artificial Sequence
  source: /note="Description of Artificial Sequence: Synthetic scFv sequence"
QSALTQPASVSGSPGQSRRISCTGTSSDVGGYNYVSWYQQHPGKAPKLMIYDVSNRPSGVSNRFSGSKSGNTASLTISGLQAEDEADYYCSSYTSSSTSKVFGGGTKLTVLGSRGGGGSGGGGSGGGGSLEMAEVQLVESGGGVVRPGGSLRLSCAASGFTFGDYGMSWVRQAPGKGLEWVSGINWNGGSTGYADSVKGRFTISRDNAKNSLYLQMNSLRAEDTAVYYCARSKYNFHVYYDYWGQGTLVTVSS

SEQ ID NO: 638 - protein, 278 aa, Artificial Sequence
  source: /note="Description of Artificial Sequence: Synthetic scFv sequence"
QSALTQPASVSGSPGQSRRISCTGTSSDVGGYNYVSWYQQHPGKAPKLMIYDVSNRPSGVSNRFSGSKSGNTASLTISGLQAEDEADYYCSSYTSSSTSKVFGGGTKLTVLGSRGGGGSGGGGSGGGGSLEMAEVQLVESGGGVVRPGGSLRLSCAASGFTFGDYGMSWVRQAPGKGLEWVSGINWNGGSTGYADSVKGRFTISRDNAKNSLYLQMNSLRAEDTAVYYCARSKYNFHVYYDYWGQGTLVTVSSTSGQAGQHHHHHHGAYPYDVPDYAS

SEQ ID NO: 639 - protein, 251 aa, Artificial Sequence
  source: /note="Description of Artificial Sequence: Synthetic scFv sequence"
QSVLTQPPAASGTPGQRVTISCSGGVSNIGSGALNWYQQLPGTAPKLLIYSYNQRPSGVSDRFSGSRSATSASLAISGLQSEDEADYYCATWDDSVNGWVFGGGTKLTVLGSRGGGGSGGGGSGGGGSLEMAQVQLVQSGAEVKKPGDSVKVSCKPSGYNFLNYGINWVRQAPGQGLEWMGWISTYTGNTNYAQKLQGRVTFTTDTSTSTAYMEMRSLRSDDTAVYYCARDLYYYEGVDYWGQGTLVTVSS

SEQ ID NO: 640 - protein, 276 aa, Artificial Sequence
  source: /note="Description of Artificial Sequence: Synthetic scFv sequence"
QSVLTQPPAASGTPGQRVTISCSGGVSNIGSGALNWYQQLPGTAPKLLIYSYNQRPSGVSDRFSGSRSATSASLAISGLQSEDEADYYCATWDDSVNGWVFGGGTKLTVLGSRGGGGSGGGGSGGGGSLEMAQVQLVQSGAEVKKPGDSVKVSCKPSGYNFLNYGINWVRQAPGQGLEWMGWISTYTGNTNYAQKLQGRVTFTTDTSTSTAYMEMRSLRSDDTAVYYCARDLYYYEGVDYWGQGTLVTVSSTSGQAGQHHHHHHGAYPYDVPDYAS

SEQ ID NO: 641 - protein, 254 aa, Artificial Sequence
  source: /note="Description of Artificial Sequence: Synthetic scFv sequence"
QSVLTQPPSASGTPGQRVTISCSGSSSNIGSNTVNWYQQLPGTAPKLLIYSNDQRPSGVPDRFSGSKSGTSASLAISGLQSEDEADYYCASWDDSLNGRYVFGTGTKVTVLGSRGGGGSGGGGSGGGGSLEMAQVQLVQSGAEVRKPGASVKVSCKTSGYTFSWYAIHWVRQAPGQRLEWMGWINAGNGNTKYSQKFQGRVSLTRDTSASTAYMELSSLRSDDTAVYYCARPDNYGSGGDVFDRGQGTMVTVSS

SEQ ID NO: 642 - protein, 279 aa, Artificial Sequence
  source: /note="Description of Artificial Sequence: Synthetic scFv sequence"
QSVLTQPPSASGTPGQRVTISCSGSSSNIGSNTVNWYQQLPGTAPKLLIYSNDQRPSGVPDRFSGSKSGTSASLAISGLQSEDEADYYCASWDDSLNGRYVFGTGTKVTVLGSRGGGGSGGGGSGGGGSLEMAQVQLVQSGAEVRKPGASVKVSCKTSGYTFSWYAIHWVRQAPGQRLEWMGWINAGNGNTKYSQKFQGRVSLTRDTSASTAYMELSSLRSDDTAVYYCARPDNYGSGGDVFDRGQGTMVTVSSTSGQAGQHHHHHHGAYPYDVPDYAS

SEQ ID NO: 643 - protein, 249 aa, Artificial Sequence
  source: /note="Description of Artificial Sequence: Synthetic scFv sequence"
QSVLTQPPSASGTPGQRVTISCSGSSSNIGSNTVNWYQQLPGTAPKLLIYSNNQRPSGVPDRFSGSKSGTSASLAISGLQSEDEADYYCAAWDDSLNGYVFGTGTKVTVLGSRGGGGSGGGGSGGGGSLEMAQVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCAREGPYDGFDSWGQGTLVTVSS

SEQ ID NO: 644 - protein, 274 aa, Artificial Sequence
  source: /note="Description of Artificial Sequence: Synthetic scFv sequence"
QSVLTQPPSASGTPGQRVTISCSGSSSNIGSNTVNWYQQLPGTAPKLLIYSNNQRPSGVPDRFSGSKSGTSASLAISGLQSEDEADYYCAAWDDSLNGYVFGTGTKVTVLGSRGGGGSGGGGSGGGGSLEMAQVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCAREGPYDGFDSWGQGTLVTVSSTSGQAGQHHHHHHGAYPYDVPDYAS

SEQ ID NO: 645 - protein, 250 aa, Artificial Sequence
  source: /note="Description of Artificial Sequence: Synthetic scFv sequence"
QSVLTQPPSASGTPGQRVTISCSGSSSNIGSNTVNWYQQLPGTAPKLLIYSNNQRPSGVPDRFSGSKSGTSASLAISGLQSEDEADYYCAAWDDSLNGYWVFGGGTKLTVLGSRGGGGSGGGGSGGGGSLEMAQVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCAREGAFDAFDIWGQGTMVTVSS

SEQ ID NO: 646 - protein, 275 aa, Artificial Sequence
  source: /note="Description of Artificial Sequence: Synthetic scFv sequence"
QSVLTQPPSASGTPGQRVTISCSGSSSNIGSNTVNWYQQLPGTAPKLLIYSNNQRPSGVPDRFSGSKSGTSASLAISGLQSEDEADYYCAAWDDSLNGYWVFGGGTKLTVLGSRGGGGSGGGGSGGGGSLEMAQVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCAREGAFDAFDIWGQGTMVTVSSTSGQAGQHHHHHHGAYPYDVPDYAS

SEQ ID NO: 647 - protein, 250 aa, Artificial Sequence
  source: /note="Description of Artificial Sequence: Synthetic scFv sequence"
QSVLTQPPSASGTPGQRVTISCSGSSSNIGTNGVNWFQQFPGTAPKLLIYTNDQRPSGVPDRFSGSKSGTSASLAISGLQSADEADYYCAVWDHSLNGPVFGGGTKLTVLGSRGGGGSGGGGSGGGGSLEMAQVQLVQSGAEVKKPGSSVKVSCKASGGTFSSYAISWVRQAPGQGLEWMGGIIPIFGTANYAQKFQGRVTITADESTSTAYMELSSLRSEDTAVYYCARGAGFDAFDIWGQGTMVTVSS

SEQ ID NO: 648 - protein, 275 aa, Artificial Sequence
  source: /note="Description of Artificial Sequence: Synthetic scFv sequence"
QSVLTQPPSASGTPGQRVTISCSGSSSNIGTNGVNWFQQFPGTAPKLLIYTNDQRPSGVPDRFSGSKSGTSASLAISGLQSADEADYYCAVWDHSLNGPVFGGGTKLTVLGSRGGGGSGGGGSGGGGSLEMAQVQLVQSGAEVKKPGSSVKVSCKASGGTFSSYAISWVRQAPGQGLEWMGGIIPIFGTANYAQKFQGRVTITADESTSTAYMELSSLRSEDTAVYYCARGAGFDAFDIWGQGTMVTVSSTSGQAGQHHHHHHGAYPYDVPDYAS

SEQ ID NO: 649 - protein, 252 aa, Artificial Sequence
  source: /note="Description of Artificial Sequence: Synthetic scFv sequence"
QSVLTQPPSASGTPGQTVTISCSGSNSNIGSNYVYWYQQLPGTAPKLLIYRNNQRPSGVPDRFSGSKSGTSASLAISGLRSEDEADYYCAAWDDSLSAYVFGTGTKVTVLGSRGGGGSGGGGSGGGGSLEMAQVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCARSSGNMVSWKDMWGQGTLVTVSS

SEQ ID NO: 650 - protein, 277 aa, Artificial Sequence
  source: /note="Description of Artificial Sequence: Synthetic scFv sequence"
QSVLTQPPSASGTPGQTVTISCSGSNSNIGSNYVYWYQQLPGTAPKLLIYRNNQRPSGVPDRFSGSKSGTSASLAISGLRSEDEADYYCAAWDDSLSAYVFGTGTKVTVLGSRGGGGSGGGGSGGGGSLEMAQVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCARSSGNMVSWKDMWGQGTLVTVSSTSGQAGQHHHHHHGAYPYDVPDYAS

SEQ ID NO: 651 - protein, 249 aa, Artificial Sequence
  source: /note="Description of Artificial Sequence: Synthetic scFv sequence"
QSVLTQPPSVSAAAGQKVTISCSGSDSNIGNNYVSWYQHLPGTAPKLLIYDVKNRPSGIPDRFSGSKSGSSATLGIAGLQPGDEADYYCGTWDSRLDAYVFGTGTKVTVLGSRGGGGSGGGGSGGGGSLEMAQMQLVQSGAEVKKPGASVKVSCKTSGFPFNIFGITWVRQAPGQGLEWMGWISGYNGNTDYPQKFQGRVTMSTDTSTSTAYMELRNLKSDDTAVYYCARGAYGGMDTWGQGTLVTVSS

SEQ ID NO: 652 - protein, 274 aa, Artificial Sequence
  source: /note="Description of Artificial Sequence: Synthetic scFv sequence"
QSVLTQPPSVSAAAGQKVTISCSGSDSNIGNNYVSWYQHLPGTAPKLLIYDVKNRPSGIPDRFSGSKSGSSATLGIAGLQPGDEADYYCGTWDSRLDAYVFGTGTKVTVLGSRGGGGSGGGGSGGGGSLEMAQMQLVQSGAEVKKPGASVKVSCKTSGFPFNIFGITWVRQAPGQGLEWMGWISGYNGNTDYPQKFQGRVTMSTDTSTSTAYMELRNLKSDDTAVYYCARGAYGGMDTWGQGTLVTVSSTSGQAGQHHHHHHGAYPYDVPDYAS

SEQ ID NO: 653 - protein, 249 aa, Artificial Sequence
  source: /note="Description of Artificial Sequence: Synthetic scFv sequence"
QSVLTQPPSVSAAPGQKVTISCSGSNSNIGNNYVSWYQQLPGTAPKLLIYDNNKRPSGIPDRFSGSRSGTSATLGITGLQTGDEADYYCGTWNTTVTPGYVFGTGTKVTVLGSRGGGGSGGGGSGGGGSLEMAEVQLVQSGAEVKKPGASVKVSCKASGYTFTSYGISWVRQAPGQGLEWMGWISAYNGNTNYAQKLQGRVTMTTDTSTSTAYMELRSLRSDDTAMYYCARSVYDLDTWGQGTLVTVSS

SEQ ID NO: 654 - protein, 274 aa, Artificial Sequence
  source: /note="Description of Artificial Sequence: Synthetic scFv sequence"
QSVLTQPPSVSAAPGQKVTISCSGSNSNIGNNYVSWYQQLPGTAPKLLIYDNNKRPSGIPDRFSGSRSGTSATLGITGLQTGDEADYYCGTWNTTVTPGYVFGTGTKVTVLGSRGGGGSGGGGSGGGGSLEMAEVQLVQSGAEVKKPGASVKVSCKASGYTFTSYGISWVRQAPGQGLEWMGWISAYNGNTNYAQKLQGRVTMTTDTSTSTAYMELRSLRSDDTAMYYCARSVYDLDTWGQGTLVTVSSTSGQAGQHHHHHHGAYPYDVPDYAS

SEQ ID NO: 655 - protein, 256 aa, Artificial Sequence
  source: /note="Description of Artificial Sequence: Synthetic scFv sequence"
QSVLTQPPSVSAPPGQKVTISCSGSSSNIGNNYVSWYQQFPGTAPKLLIYDNNKRPSGISDRFSGSKSGTSATLGIAGLQTGDEADYYCGTWDTSLSGFYVFGSGTKVTVLGSRGGGGSGGGGSGGGGSLEMAEVQLVQSGAEVKKPGASVKVSCKASGYTFTSYTISWVRQAPGQGLEWMGWISTYNGLTNYAQNLQGRVTMTTDTFTTTAYMELRSLRSDDTAVYYCVREGSPDYGDFASFDYWGQGTLVTVSS

SEQ ID NO: 656 - protein, 281 aa, Artificial Sequence
  source: /note="Description of Artificial Sequence: Synthetic scFv sequence"
QSVLTQPPSVSAPPGQKVTISCSGSSSNIGNNYVSWYQQFPGTAPKLLIYDNNKRPSGISDRFSGSKSGTSATLGIAGLQTGDEADYYCGTWDTSLSGFYVFGSGTKVTVLGSRGGGGSGGGGSGGGGSLEMAEVQLVQSGAEVKKPGASVKVSCKASGYTFTSYTISWVRQAPGQGLEWMGWISTYNGLTNYAQNLQGRVTMTTDTFTTTAYMELRSLRSDDTAVYYCVREGSPDYGDFASFDYWGQGTLVTVSSTSGQAGQHHHHHHGAYPYDVPDYAS

SEQ ID NO: 657 - protein, 259 aa, Artificial Sequence
  source: /note="Description of Artificial Sequence: Synthetic scFv sequence"
QSVLTQPPSVSGAPGQGVTIPCTGSSSNIGAGYDVHWYQQLPGTAPKLLIYGNNNRPSGVPDRFSGSRSGSSASLAITGLQAEDEADYYCQSYDSSLSDVVFGGGTKVTVLGSRGGGGSGGGGSGGGGSLEMAEVQLVQSGAEVKKPGATVKISCKVSGYTFTDYYMHWVQQAPGKGLEWMGLVDPEDGETIYAEKFQGRVTITADTSTDTAYMELSSLRSEDTAVYYCARYWSYSFDYLYMPEGNDWWGQGTLVTVSS

SEQ ID NO: 658 - protein, 284 aa, Artificial Sequence
  source: /note="Description of Artificial Sequence: Synthetic scFv sequence"
QSVLTQPPSVSGAPGQGVTIPCTGSSSNIGAGYDVHWYQQLPGTAPKLLIYGNNNRPSGVPDRFSGSRSGSSASLAITGLQAEDEADYYCQSYDSSLSDVVFGGGTKVTVLGSRGGGGSGGGGSGGGGSLEMAEVQLVQSGAEVKKPGATVKISCKVSGYTFTDYYMHWVQQAPGKGLEWMGLVDPEDGETIYAEKFQGRVTITADTSTDTAYMELSSLRSEDTAVYYCARYWSYSFDYLYMPEGNDWWGQGTLVTVSSTSGQAGQHHHHHHGAYPYDVPDYAS

SEQ ID NO: 659 - protein, 251 aa, Artificial Sequence
  source: /note="Description of Artificial Sequence: Synthetic scFv sequence"
QSVLTQPPSVSGAPGQRVTISCTGSSSNIGAGFDVHWYQLLPGTAPKLLIYANSNRPSGVPDRFSGSKSGTSASLAITGLLAEDEADYYCQSYDSSLSGVVFGGGTKLTVLGSRGGGGSGGGGSGGGGSLEMAQVQLVQSGAEVKKPGSSVKVSCKASGGTFSSYAISWVRQAPGQGLEWMGGIIPIFGTANYAQKFQGRVTITADESTSTAYMELSSLRSEDTAVYYCARGASFDRHDNWGQGTLVTVSS

SEQ ID NO: 660 - protein, 276 aa, Artificial Sequence
  source: /note="Description of Artificial Sequence: Synthetic scFv sequence"
QSVLTQPPSVSGAPGQRVTISCTGSSSNIGAGFDVHWYQLLPGTAPKLLIYANSNRPSGVPDRFSGSKSGTSASLAITGLLAEDEADYYCQSYDSSLSGVVFGGGTKLTVLGSRGGGGSGGGGSGGGGSLEMAQVQLVQSGAEVKKPGSSVKVSCKASGGTFSSYAISWVRQAPGQGLEWMGGIIPIFGTANYAQKFQGRVTITADESTSTAYMELSSLRSEDTAVYYCARGASFDRHDNWGQGTLVTVSSTSGQAGQHHHHHHGAYPYDVPDYAS

SEQ ID NO: 661 - protein, 249 aa, Artificial Sequence
  source: /note="Description of Artificial Sequence: Synthetic scFv sequence"
QSVLTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGYVFGTGTKVTVLGSRGGGGSGGGGSGGGGSLEMAQVQLVQSGAEVKKPGASVKVSCKVSGYTLTELSMHWVRQAPGKGLEWMGGFDPEDGETIYAQKFQGRVTMTEDTSTDTAYMELSSLRSEDTAVYYCARYSGVYYDWGQGTLVTVSS

SEQ ID NO: 662 - protein, 274 aa, Artificial Sequence
  source: /note="Description of Artificial Sequence: Synthetic scFv sequence"
QSVLTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGYVFGTGTKVTVLGSRGGGGSGGGGSGGGGSLEMAQVQLVQSGAEVKKPGASVKVSCKVSGYTLTELSMHWVRQAPGKGLEWMGGFDPEDGETIYAQKFQGRVTMTEDTSTDTAYMELSSLRSEDTAVYYCARYSGVYYDWGQGTLVTVSSTSGQAGQHHHHHHGAYPYDVPDYAS

SEQ ID NO: 663 - protein, 253 aa, Artificial Sequence
  source: /note="Description of Artificial Sequence: Synthetic scFv sequence"
QSVLTQPPSVSGAPGQRVTISCTGSSSNIGARYDVHWYQQLPGTAPRLLISANYDRPSGVPDRFSGSKSGTSASLAITGLQAEDEADYYCQSYDSSVSAWVFGGGTKVTVLGSRGGGGSGGGGSGGGGSLEMAEVQLVQSGAEVKEPGASVRISCQASGYNFISYYMHWVRQAPGQGLEWMGTINPGSGETDYSQKLQGRVTMTRDPSTGTFDMGLSSLTSGDTAVYYCATGLIRGASDAFNRGRGTMVTVSS

SEQ ID NO: 664 - protein, 278 aa, Artificial Sequence
  source: /note="Description of Artificial Sequence: Synthetic scFv sequence"
QSVLTQPPSVSGAPGQRVTISCTGSSSNIGARYDVHWYQQLPGTAPRLLISANYDRPSGVPDRFSGSKSGTSASLAITGLQAEDEADYYCQSYDSSVSAWVFGGGTKVTVLGSRGGGGSGGGGSGGGGSLEMAEVQLVQSGAEVKEPGASVRISCQASGYNFISYYMHWVRQAPGQGLEWMGTINPGSGETDYSQKLQGRVTMTRDPSTGTFDMGLSSLTSGDTAVYYCATGLIRGASDAFNRGRGTMVTVSSTSGQAGQHHHHHHGAYPYDVPDYAS

SEQ ID NO: 665 - protein, 251 aa, Artificial Sequence
  source: /note="Description of Artificial Sequence: Synthetic scFv sequence"
QSVLTQPPSVSGAPGQRVTISCTGSTSNIGAGYDVHWYQQLPGTAPKLLINNNRNRPSGVPDRFSGSKSGTSATLGITGLQTGDEADYYCGTWDGSLTGAVFGGGTKLTVLGSRGGGGSGGGGSGGGGSLEMAEVQLVQSGAEVKKPGSSVKVSCKASGGTFSSYAISWVRQAPGQGLEWMGGIIPIFGTANYAQKFQGRVTITADESTSTAYMELSSLRSEDTAVYYCARGSALDHYDRWGQGTLVTVSS

SEQ ID NO: 666 - protein, 276 aa, Artificial Sequence
  source: /note="Description of Artificial Sequence: Synthetic scFv sequence"
QSVLTQPPSVSGAPGQRVTISCTGSTSNIGAGYDVHWYQQLPGTAPKLLINNNRNRPSGVPDRFSGSKSGTSATLGITGLQTGDEADYYCGTWDGSLTGAVFGGGTKLTVLGSRGGGGSGGGGSGGGGSLEMAEVQLVQSGAEVKKPGSSVKVSCKASGGTFSSYAISWVRQAPGQGLEWMGGIIPIFGTANYAQKFQGRVTITADESTSTAYMELSSLRSEDTAVYYCARGSALDHYDRWGQGTLVTVSSTSGQAGQHHHHHHGAYPYDVPDYAS

SEQ ID NO: 667 - protein, 260 aa, Artificial Sequence
  source: /note="Description of Artificial Sequence: Synthetic scFv sequence"
QSVLTQPPSVSGAPGQRVTVSCTGSRSNIGAGYDVHWYQQLPGTAPKLLIYGNSNRPPGVPDRFSGSKSGTSASLVITGLQAEDAADYYCQSYDNTVRESPYVFGTGTKVTVLGSRGGGGSGGGGSGGGGSLEMAEVQLVQSGAEVKKPGASVKVSCKVSGYTLTELSMHWVRQAPGKGLEWMGGFDPEDGETIYAQKFQGRVTMTEDTSTDTAYMELSSLRSEDTAVYYCATESNLVSRHYYYYGMDVWGQGTTVTVSS

SEQ ID NO: 668 - protein, 285 aa, Artificial Sequence
  source: /note="Description of Artificial Sequence: Synthetic scFv sequence"
QSVLTQPPSVSGAPGQRVTVSCTGSRSNIGAGYDVHWYQQLPGTAPKLLIYGNSNRPPGVPDRFSGSKSGTSASLVITGLQAEDAADYYCQSYDNTVRESPYVFGTGTKVTVLGSRGGGGSGGGGSGGGGSLEMAEVQLVQSGAEVKKPGASVKVSCKVSGYTLTELSMHWVRQAPGKGLEWMGGFDPEDGETIYAQKFQGRVTMTEDTSTDTAYMELSSLRSEDTAVYYCATESNLVSRHYYYYGMDVWGQGTTVTVSSTSGQAGQHHHHHHGAYPYDVPDYAS

SEQ ID NO: 669 - protein, 250 aa, Artificial Sequence
  source: /note="Description of Artificial Sequence: Synthetic scFv sequence"
QSVLTQPPSVSVSPGQTASISCSGNKLGTKYVYWYQKRPGQSPVLVMYEDNQRPSGIPERFSGSNSGNTATLTIRGTQTVDEADYYCQAWDSDTFVVFGGGTKVTVLGSRGGGGSGGGGSGGGGSLEMAEVQLVETGGGVVQPGRSLRLSCAASGFTFSSYGMHWVRQAPGKGLEWVAVISHDGSNKYYADSVKGRFTISRDNSKDTLYLQMNSLRGEDTAVYYCARSNQWSGYFSFDYWGQGTLVTVSS

SEQ ID NO: 670 - protein, 275 aa, Artificial Sequence
  source: /note="Description of Artificial Sequence: Synthetic scFv sequence"
QSVLTQPPSVSVSPGQTASISCSGNKLGTKYVYWYQKRPGQSPVLVMYEDNQRPSGIPERFSGSNSGNTATLTIRGTQTVDEADYYCQAWDSDTFVVFGGGTKVTVLGSRGGGGSGGGGSGGGGSLEMAEVQLVETGGGVVQPGRSLRLSCAASGFTFSSYGMHWVRQAPGKGLEWVAVISHDGSNKYYADSVKGRFTISRDNSKDTLYLQMNSLRGEDTAVYYCARSNQWSGYFSFDYWGQGTLVTVSSTSGQAGQHHHHHHGAYPYDVPDYAS

SEQ ID NO: 671 - protein, 248 aa, Artificial Sequence
  source: /note="Description of Artificial Sequence: Synthetic scFv sequence"
QSVLTQPPSVSVSPGQTATIACSGHKLGDKYASWYQQKSGQSPVLIIYQDNKRPSGIPERFSGSNSGNTATLTISGTQALDEADYYCQAWDSSTYVAFGGGTKLTVLGSRGGGGSGGGGSGGGGSLEMAQVQLQESGPGLVKPSETLSLTCVVSGGSISSSNWWSWVRQPPGKGLEWIGEIYHSGSPNYNPSLKSRVTISVDKSKNQFSLKLSSVTAADTAVYYCARMTTHTFGYDAWGQGTLVTVSS

SEQ ID NO: 672 - protein, 273 aa, Artificial Sequence
  source: /note="Description of Artificial Sequence: Synthetic scFv sequence"
QSVLTQPPSVSVSPGQTATIACSGHKLGDKYASWYQQKSGQSPVLIIYQDNKRPSGIPERFSGSNSGNTATLTISGTQALDEADYYCQAWDSSTYVAFGGGTKLTVLGSRGGGGSGGGGSGGGGSLEMAQVQLQESGPGLVKPSETLSLTCVVSGGSISSSNWWSWVRQPPGKGLEWIGEIYHSGSPNYNPSLKSRVTISVDKSKNQFSLKLSSVTAADTAVYYCARMTTHTFGYDAWGQGTLVTVSSTSGQAGQHHHHHHGAYPYDVPDYAS

SEQ ID NO: 673 - protein, 257 aa, Artificial Sequence
  source: /note="Description of Artificial Sequence: Synthetic scFv sequence"
QSVVTQPPSASGTPGQRVTISCSGSSSNIGSNYVYWYQQLPGTAPKLLIYSNNQRPSGVPDRFSGSKSGTSASLAISGLRSEDEADYYCAAWDDSLSGYVFGTGTKLTVLGSRGGGGSGGGGSGGGGSLEMAQVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARLYEGGYHGWGSWLSSDSWGQGTLVTVSS

SEQ ID NO: 674 - protein, 282 aa, Artificial Sequence
  source: /note="Description of Artificial Sequence: Synthetic scFv sequence"
QSVVTQPPSASGTPGQRVTISCSGSSSNIGSNYVYWYQQLPGTAPKLLIYSNNQRPSGVPDRFSGSKSGTSASLAISGLRSEDEADYYCAAWDDSLSGYVFGTGTKLTVLGSRGGGGSGGGGSGGGGSLEMAQVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARLYEGGYHGWGSWLSSDSWGQGTLVTVSSTSGQAGQHHHHHHGAYPYDVPDYAS

SEQ ID NO: 675 - protein, 256 aa, Artificial Sequence
  source: /note="Description of Artificial Sequence: Synthetic scFv sequence"
QSVVTQPPSVSAAPGEKVTISCSGSNFNVGNNDVSWYQQLPGAAPKLLIYDNNKRPSGIPDRFSGSKSGTSATLDITGLHSDDEADYYCGTWDSSLNTGGVFGTGTKVTVLGSRGGGGSGGGGSGGGGSLEMAEVQLVQSGAEVKKPGASVKVSCKASGYTFTSYTISWVRQAPGQGLEWMGWISTYNGLTNYAQNLQGRVTMTTDTFTTTAYMELRSLRSDDTAVYYCVREGSPDYGDFASFDYWGQGTLVTVSS

SEQ ID NO: 676 - protein, 281 aa, Artificial Sequence
  source: /note="Description of Artificial Sequence: Synthetic scFv sequence"
QSVVTQPPSVSAAPGEKVTISCSGSNFNVGNNDVSWYQQLPGAAPKLLIYDNNKRPSGIPDRFSGSKSGTSATLDITGLHSDDEADYYCGTWDSSLNTGGVFGTGTKVTVLGSRGGGGSGGGGSGGGGSLEMAEVQLVQSGAEVKKPGASVKVSCKASGYTFTSYTISWVRQAPGQGLEWMGWISTYNGLTNYAQNLQGRVTMTTDTFTTTAYMELRSLRSDDTAVYYCVREGSPDYGDFASFDYWGQGTLVTVSSTSGQAGQHHHHHHGAYPYDVPDYAS

SEQ ID NO: 677 - protein, 252 aa, Artificial Sequence
  source: /note="Description of Artificial Sequence: Synthetic scFv sequence"
QSVVTQPPSVSAAPGQKVTISCSGSSSNIGNNYVSWYQQLPGTAPKLLIYDNNKRPSGIPDRFSGSKSGTSATLGITGLQTGDEADYYCGTWDSSLGAPYVFGTGTKVTVLGSRGGGGSGGGGSGGGGSLEMAEVQLVQSWGGSEQPGRSLRLSCAASGFTFDDYAMHWVRQAPGKGLEWVSGISWNSGSIGYADSVKGRFTISRDNAKNSLYLQMNSLRAEDTAMYYCARYRQVGSAYDSWGQGTLVTVSS

SEQ ID NO: 678 - protein, 277 aa, Artificial Sequence
  source: /note="Description of Artificial Sequence: Synthetic scFv sequence"
QSVVTQPPSVSAAPGQKVTISCSGSSSNIGNNYVSWYQQLPGTAPKLLIYDNNKRPSGIPDRFSGSKSGTSATLGITGLQTGDEADYYCGTWDSSLGAPYVFGTGTKVTVLGSRGGGGSGGGGSGGGGSLEMAEVQLVQSWGGSEQPGRSLRLSCAASGFTFDDYAMHWVRQAPGKGLEWVSGISWNSGSIGYADSVKGRFTISRDNAKNSLYLQMNSLRAEDTAMYYCARYRQVGSAYDSWGQGTLVTVSSTSGQAGQHHHHHHGAYPYDVPDYAS

SEQ ID NO: 679 - protein, 256 aa, Artificial Sequence
  source: /note="Description of Artificial Sequence: Synthetic scFv sequence"
QSVVTQPPSVSAAPGQKVTISCSGSSSNIGNNYVSWYQQLPGTAPKLLIYDNNKRPSGIPDRFSGSKSGTSATLGITGLQTGDEADYYCGTWDSSLSAAYVFGTGTKVTVLGSRGGGGSGGGGSGGGGSLEMAQVQLVQSGAEVKKPGASVKVSCKASGYSFTSYTISWVRQAPGQGLEWMGWVSTYNGLRNYAQNLQGRVTMTTDTLTTTAYMELRSLRSDDTAVYYCVREGSPDYGDFAAFDYWGQGTLVTVSS

SEQ ID NO: 680 - protein, 281 aa, Artificial Sequence
  source: /note="Description of Artificial Sequence: Synthetic scFv sequence"
QSVVTQPPSVSAAPGQKVTISCSGSSSNIGNNYVSWYQQLPGTAPKLLIYDNNKRPSGIPDRFSGSKSGTSATLGITGLQTGDEADYYCGTWDSSLSAAYVFGTGTKVTVLGSRGGGGSGGGGSGGGGSLEMAQVQLVQSGAEVKKPGASVKVSCKASGYSFTSYTISWVRQAPGQGLEWMGWVSTYNGLRNYAQNLQGRVTMTTDTLTTTAYMELRSLRSDDTAVYYCVREGSPDYGDFAAFDYWGQGTLVTVSSTSGQAGQHHHHHHGAYPYDVPDYAS

SEQ ID NO: 681 - protein, 253 aa, Artificial Sequence
  source: /note="Description of Artificial Sequence: Synthetic scFv sequence"
QSVVTQPPSVSAAPGQKVTISCSGSSSNIGNNYVSWYQQLPGTAPKLLIYDNNKRPSGIPDRFSGSKSGTSATLGITGLQTGDEADYYCGTWDSSLSAYVFGTGTKVTVLGSRGGGGSGGGGSGGGGSLEMAQVQLVQSGAEVKKPGASVKVSCKASGYTFTNYALHWVRQAPGQGLEWMAWINGGNGNTKYSQNFQGRVTITRDTSASTAYMELSSLRSEDTAVYYCAKPEETAGTIHFDYWGQGTPVTVSS

SEQ ID NO: 682 - protein, 278 aa, Artificial Sequence
  source: /note="Description of Artificial Sequence: Synthetic scFv sequence"
QSVVTQPPSVSAAPGQKVTISCSGSSSNIGNNYVSWYQQLPGTAPKLLIYDNNKRPSGIPDRFSGSKSGTSATLGITGLQTGDEADYYCGTWDSSLSAYVFGTGTKVTVLGSRGGGGSGGGGSGGGGSLEMAQVQLVQSGAEVKKPGASVKVSCKASGYTFTNYALHWVRQAPGQGLEWMAWINGGNGNTKYSQNFQGRVTITRDTSASTAYMELSSLRSEDTAVYYCAKPEETAGTIHFDYWGQGTPVTVSSTSGQAGQHHHHHHGAYPYDVPDYAS

SEQ ID NO: 683 - protein, 249 aa, Artificial Sequence
  source: /note="Description of Artificial Sequence: Synthetic scFv sequence"
QSVVTQPPSVSAAPGQKVTISCSGSTSNIGNNDVSWYQQLPGTAPKLLIYDNNKRPSGIPDRFSGSKSGTSATLGITGLQTGDEADYYCGTWDSSVSASWVFGRGTKLTVLGSRGGGGSGGGGSGGGGSLEMAQVQLVQSGAEVKKPGASVKVSCKASGYTFTSYGISWVRQAPGQGLEWMGWISAYNGNTNYPQKLQGRVTMTTDPSTSTAYMELRSLRSDDTAVYYCARSMTSFDYWGQGTLVTVSS

SEQ ID NO: 684 - protein, 274 aa, Artificial Sequence
  source: /note="Description of Artificial Sequence: Synthetic scFv sequence"
QSVVTQPPSVSAAPGQKVTISCSGSTSNIGNNDVSWYQQLPGTAPKLLIYDNNKRPSGIPDRFSGSKSGTSATLGITGLQTGDEADYYCGTWDSSVSASWVFGRGTKLTVLGSRGGGGSGGGGSGGGGSLEMAQVQLVQSGAEVKKPGASVKVSCKASGYTFTSYGISWVRQAPGQGLEWMGWISAYNGNTNYPQKLQGRVTMTTDPSTSTAYMELRSLRSDDTAVYYCARSMTSFDYWGQGTLVTVSSTSGQAGQHHHHHHGAYPYDVPDYAS

SEQ ID NO: 685 - protein, 274 aa, Artificial Sequence
  source: /note="Description of Artificial Sequence: Synthetic scFv sequence"
QSVVTQPPSVSAAPGQRVTISCSGSSSNISIYDVSWYQQLPGTAPKLLIYGNNKRPSGIADRFSGSTSGTSATLGITGLQTGDEADYYCGTWDDSLSGGVFGGGTKLTVLGRGGGGSGGGGSGGGGSLEMAQMQLVQSGAEVKKPGSSVKVSCEASGGTLSSYAINWVRQAPGQGLEWMGGIIPMFGTAHYAQKFQGRVTITADESTKTAYMELSSLRSEDTAVYYCARGVHYASFDHWGQGTLVTVSSTSGQAGQHHHHHHGAYPYDVPDYAS

SEQ ID NO: 686 - protein, 250 aa, Artificial Sequence
  source: /note="Description of Artificial Sequence: Synthetic scFv sequence"
QSVVTQPPSVSAAPGQRVTISCSGSSSNISIYDVSWYQQLPGTAPKLLIYGNNKRPSGIADRFSGSTSGTSATLGITGLQTGDEADYYCGTWDDSLSGGVFGGGTKLTVLGSRGGGGSGGGGSGGGGSLEMAQMQLVQSGAEVKKPGSSVKVSCEASGGTLSSYAINWVRQAPGQGLEWMGGIIPMFGTAHYAQKFQGRVTITADESTKTAYMELSSLRSEDTAVYYCARGVHYASFDHWGQGTLVTVSS

SEQ ID NO: 687 - protein, 275 aa, Artificial Sequence
  source: /note="Description of Artificial Sequence: Synthetic scFv sequence"
QSVVTQPPSVSAAPGQRVTISCSGSSSNISIYDVSWYQQLPGTAPKLLIYGNNKRPSGIADRFSGSTSGTSATLGITGLQTGDEADYYCGTWDDSLSGGVFGGGTKLTVLGSRGGGGSGGGGSGGGGSLEMAQMQLVQSGAEVKKPGSSVKVSCEASGGTLSSYAINWVRQAPGQGLEWMGGIIPMFGTAHYAQKFQGRVTITADESTKTAYMELSSLRSEDTAVYYCARGVHYASFDHWGQGTLVTVSSTSGQAGQHHHHHHGAYPYDVPDYAS

SEQ ID NO: 688 - protein, 250 aa, Artificial Sequence
  source: /note="Description of Artificial Sequence: Synthetic scFv sequence"
QSVVTQPPSVSGAPGQRVTISCTGSSSNIGAGYDVNWYQQFPGTAPKLLIYGNSNRPSGVPDRFSGSKSGTSASLAITGLQAEDEADYYCQSYDSSLSGSYVFGTGTKVTVLGSRGGGGSGGGGSGGGGSLEMAQMQLVQSGAEVKKPGASVKVSCKASGYTLTELSMHWVRQAPGKGLEWMGGFDPEDGETIYAQKFQGRVTMTEDTSTDTAYMELSSLRSEDTAVYYCARMSSMYYDWGQGTLVTVSS

SEQ ID NO: 689 - protein, 275 aa, Artificial Sequence
  source: /note="Description of Artificial Sequence: Synthetic scFv sequence"
QSVVTQPPSVSGAPGQRVTISCTGSSSNIGAGYDVNWYQQFPGTAPKLLIYGNSNRPSGVPDRFSGSKSGTSASLAITGLQAEDEADYYCQSYDSSLSGSYVFGTGTKVTVLGSRGGGGSGGGGSGGGGSLEMAQMQLVQSGAEVKKPGASVKVSCKASGYTLTELSMHWVRQAPGKGLEWMGGFDPEDGETIYAQKFQGRVTMTEDTSTDTAYMELSSLRSEDTAVYYCARMSSMYYDWGQGTLVTVSSTSGQAGQHHHHHHGAYPYDVPDYAS

SEQ ID NO: 690 - protein, 251 aa, Artificial Sequence
  source: /note="Description of Artificial Sequence: Synthetic scFv sequence"
QSVVTQPPSVSGAPGQRVTISCTGSTSNIGAGYDVHWYQQLPGTAPKLLIYTNNFRPSGVPDRFSASKSGTSASLAITGLQAEDEADYYCGTWDSSLSAVVFGGGTKLTVLGSRGGGGSGGGGSGGGGSLEMAEVQLVESGTEVKKPGASVKVSCKASGYMFTSYGLNWVRQAPGQGLEWMGWISANNGKTNYAKKFQDRVTMTRDTSTSTGYMELRSLRSDDTAVYYCARHIGGSYFDRWGQGTLVTVSS

SEQ ID NO: 691 - protein, 276 aa, Artificial Sequence
  source: /note="Description of Artificial Sequence: Synthetic scFv sequence"
QSVVTQPPSVSGAPGQRVTISCTGSTSNIGAGYDVHWYQQLPGTAPKLLIYTNNFRPSGVPDRFSASKSGTSASLAITGLQAEDEADYYCGTWDSSLSAVVFGGGTKLTVLGSRGGGGSGGGGSGGGGSLEMAEVQLVESGTEVKKPGASVKVSCKASGYMFTSYGLNWVRQAPGQGLEWMGWISANNGKTNYAKKFQDRVTMTRDTSTSTGYMELRSLRSDDTAVYYCARHIGGSYFDRWGQGTLVTVSSTSGQAGQHHHHHHGAYPYDVPDYAS

SEQ ID NO: 692 - protein, 255 aa, Artificial Sequence
  source: /note="Description of Artificial Sequence: Synthetic scFv sequence"
QSVVTQPPSVSGAPGQTVTISCTGGSSNIGTGYFVNWYQQVPGKAPKLLILGNNNRPSGVPDRLSGSTSGTSASLAITGLQAEDEGTYYCQSYDSSLSGYVFGTGTKVTVLGSRGGGGSGGGGSGGGGSLEMAQVQLQQSGPGLVKPSQTLSLTCGISGDSVSTNSVAWHWIRQSPSRGLEWLGRTYYRSKWSNDYGVSVKSRITIIPDTSKNQFSLQLNSVTPEDTAVYYCARSSSWYQIFDYWGQGTLVTVSS

SEQ ID NO: 693 - protein, 280 aa, Artificial Sequence
  source: /note="Description of Artificial Sequence: Synthetic scFv sequence"
QSVVTQPPSVSGAPGQTVTISCTGGSSNIGTGYFVNWYQQVPGKAPKLLILGNNNRPSGVPDRLSGSTSGTSASLAITGLQAEDEGTYYCQSYDSSLSGYVFGTGTKVTVLGSRGGGGSGGGGSGGGGSLEMAQVQLQQSGPGLVKPSQTLSLTCGISGDSVSTNSVAWHWIRQSPSRGLEWLGRTYYRSKWSNDYGVSVKSRITIIPDTSKNQFSLQLNSVTPEDTAVYYCARSSSWYQIFDYWGQGTLVTVSSTSGQAGQHHHHHHGAYPYDVPDYAS

SEQ ID NO: 694 - protein, 247 aa, Artificial Sequence
  source: /note="Description of Artificial Sequence: Synthetic scFv sequence"
QSVVTQPPSVSVAPGKTARITCGGNNIGSKSVHWYQQKPGQAPVLVIYYDSDRPSGIPERFSGSNSGNTATLTISRVEAGDEADYYCQVWDSSSDVVFGGGTKLTVLGSRGGGGSGGGGSGGGGSLEMAEVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCARWGGFGAVDHWGQGTLVTVSS

SEQ ID NO: 695 - protein, 272 aa, Artificial Sequence
  source: /note="Description of Artificial Sequence: Synthetic scFv sequence"
QSVVTQPPSVSVAPGKTARITCGGNNIGSKSVHWYQQKPGQAPVLVIYYDSDRPSGIPERFSGSNSGNTATLTISRVEAGDEADYYCQVWDSSSDVVFGGGTKLTVLGSRGGGGSGGGGSGGGGSLEMAEVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCARWGGFGAVDHWGQGTLVTVSSTSGQAGQHHHHHHGAYPYDVPDYAS

SEQ ID NO: 696 - protein, 245 aa, Artificial Sequence
  source: /note="Description of Artificial Sequence: Synthetic scFv sequence"
SSELTQDPAVSVALGQTVKITCQGDSLTDYHATWYQQKPGQAPVAVIYATNNRPTGIPDRFSGSSSGNTASLTITGAQAEDEADYYCNSRDSGTDEVLFGGGTKLTVLGSRGGGGSGGGGSGGGGSLEMAEVQLVETGGGLVKPGGSLRLSCAASGFTFSSYSMNWVRQAPGKGLEWVSSISSSSSYIYYADSVKGRFTISRDNAKNSLYLQMNSLRAEDTAVYYCARGQGYDYWGQGTLVTVSS

SEQ ID NO: 697 - protein, 270 aa, Artificial Sequence
  source: /note="Description of Artificial Sequence: Synthetic scFv sequence"
SSELTQDPAVSVALGQTVKITCQGDSLTDYHATWYQQKPGQAPVAVIYATNNRPTGIPDRFSGSSSGNTASLTITGAQAEDEADYYCNSRDSGTDEVLFGGGTKLTVLGSRGGGGSGGGGSGGGGSLEMAEVQLVETGGGLVKPGGSLRLSCAASGFTFSSYSMNWVRQAPGKGLEWVSSISSSSSYIYYADSVKGRFTISRDNAKNSLYLQMNSLRAEDTAVYYCARGQGYDYWGQGTLVTVSSTSGQAGQHHHHHHGAYPYDVPDYAS

SEQ ID NO: 698 - protein, 250 aa, Artificial Sequence
  source: /note="Description of Artificial Sequence: Synthetic scFv sequence"
SYELTQPPAASGTPGQRVTISCSGGVSNIGSGALNWYQQLPGTAPKLLIYSYNQRPSGVSDRFSGSRSATSASLAISGLQSEDEADYYCATWDDSVNGWVFGGGTKLTVLGSRGGGGSGGGGSGGGGSLEMAEVQLVESGAEVKKPGDSVKVSCKPSGYNFLNYGINWVRQAPGQGLEWMGWISTYTGNTNYAQKLQGRVTFTTDTSTSTAYMEMRSLRSDDTAVYYCARQQGGGWYDVWGQGTLVTVSS

SEQ ID NO: 699 - protein, 275 aa, Artificial Sequence
  source: /note="Description of Artificial Sequence: Synthetic scFv sequence"
SYELTQPPAASGTPGQRVTISCSGGVSNIGSGALNWYQQLPGTAPKLLIYSYNQRPSGVSDRFSGSRSATSASLAISGLQSEDEADYYCATWDDSVNGWVFGGGTKLTVLGSRGGGGSGGGGSGGGGSLEMAEVQLVESGAEVKKPGDSVKVSCKPSGYNFLNYGINWVRQAPGQGLEWMGWISTYTGNTNYAQKLQGRVTFTTDTSTSTAYMEMRSLRSDDTAVYYCARQQGGGWYDVWGQGTLVTVSSTSGQAGQHHHHHHGAYPYDVPDYAS

SEQ ID NO: 700 - protein, 284 aa, Artificial Sequence
  source: /note="Description of Artificial Sequence: Synthetic scFv sequence"
SYELTQPPSASGTPGQRVTISCSGSSSNIGSNTVNWYQQLPGTAPKLLIYSNNQRPSGVPDRFSGSKSGTSASLAISGLQSEDEADYYCAAWDDSLNGYVFGTGTKVTVLGSRGGGGSGGGGSGGGGSLEMAEVQLVESGAEVKKPGASVKVSCKASGYTFTSYGISWVRQAPGQGLEWMGWISAYNGNTNYAQKLQGRVTMTTDTSTSTAYMELRSLRSDDTAVYYCARDLSRGANPHYYYYYGMDVWGQGTTVTVSSTSGQAGQHHHHHHGAYPYDVPDYAS

SEQ ID NO: 701 - protein, 252 aa, Artificial Sequence
  source: /note="Description of Artificial Sequence: Synthetic scFv sequence"
SYELTQPPSASGTPGQRVTISCSGSSSNIGSNYVYWYQQLPGTAPKLFIYRNNQRPSGVPDRFSGSKSGTSASLAISGLRSEDEADYYCAAWDDSLSGYLFGTGTKVTVLGSRGGGGSGGGGSGGGGSLEMAEVQLVESGGGLVQPGRSLRLSCAASGFTFDDYAMHWVRQAPGKGLEWVSGISWNSGSIGYADSVKGRFTISRDNAKNSLYLQMNSLRAEDTALYYCANGDSNYYYGMDVWGQGTTVTVSS

SEQ ID NO: 702 - protein, 277 aa, Artificial Sequence
  source: /note="Description of Artificial Sequence: Synthetic scFv sequence"
SYELTQPPSASGTPGQRVTISCSGSSSNIGSNYVYWYQQLPGTAPKLFIYRNNQRPSGVPDRFSGSKSGTSASLAISGLRSEDEADYYCAAWDDSLSGYLFGTGTKVTVLGSRGGGGSGGGGSGGGGSLEMAEVQLVESGGGLVQPGRSLRLSCAASGFTFDDYAMHWVRQAPGKGLEWVSGISWNSGSIGYADSVKGRFTISRDNAKNSLYLQMNSLRAEDTALYYCANGDSNYYYGMDVWGQGTTVTVSSTSGQAGQHHHHHHGAYPYDVPDYAS

SEQ ID NO: 703 - protein, 246 aa, Artificial Sequence
  source: /note="Description of Artificial Sequence: Synthetic scFv sequence"
SYVLTQPLSVSVAPGKTARITCGGNNIGSKTVHWYQQKPGQAPVLVIYYDSDRPSGIPERFSGSNSGNTATLTISRVEAGDEADYYCQVWDSSSDHRVFGGGTKLTVLGSRGGGGSGGGGSGGGGSLEMAQVQLQESGPGLVKPSETLSLTCNVSGYSISSGYFWGWIRQPPGKGLEWIGSIYHSRSTYYNPSLKSRVTISVDTSKNQFSLKLNSVTAADTAVYYCARGYGYFDYWGQGTLVTVSS

SEQ ID NO: 704 - protein, 271 aa, Artificial Sequence
  source: /note="Description of Artificial Sequence: Synthetic scFv sequence"
SYVLTQPLSVSVAPGKTARITCGGNNIGSKTVHWYQQKPGQAPVLVIYYDSDRPSGIPERFSGSNSGNTATLTISRVEAGDEADYYCQVWDSSSDHRVFGGGTKLTVLGSRGGGGSGGGGSGGGGSLEMAQVQLQESGPGLVKPSETLSLTCNVSGYSISSGYFWGWIRQPPGKGLEWIGSIYHSRSTYYNPSLKSRVTISVDTSKNQFSLKLNSVTAADTAVYYCARGYGYFDYWGQGTLVTVSSTSGQAGQHHHHHHGAYPYDVPDYAS

SEQ ID NO: 705 - protein, 253 aa, Artificial Sequence
  source: /note="Description of Artificial Sequence: Synthetic scFv sequence"
SYVLTQPPSVSVAPGKTARISCGGNDIGSKSVFWYQQRPGQAPVLVVYDDSDRPSGLPERFSGFNSGNTATLTISRVEAGDEADYYCQVWDSSSDHYVFGTGTKVTVLGSRGGGGSGGGGSGGGGSLEMAQVQLVESGGGLVQPGRSLRLSCAASGFTFDDYAMHWVRQAPGKGLEWVSGISWNSGSIGYADSVKGRFTISRDNAKNSLYLQMNSLRAEDTALYYCAKDITYGSGSYGAFDIWGQGTMVTVSS

SEQ ID NO: 706 - protein, 278 aa, Artificial Sequence
  source: /note="Description of Artificial Sequence: Synthetic scFv sequence"
SYVLTQPPSVSVAPGKTARISCGGNDIGSKSVFWYQQRPGQAPVLVVYDDSDRPSGLPERFSGFNSGNTATLTISRVEAGDEADYYCQVWDSSSDHYVFGTGTKVTVLGSRGGGGSGGGGSGGGGSLEMAQVQLVESGGGLVQPGRSLRLSCAASGFTFDDYAMHWVRQAPGKGLEWVSGISWNSGSIGYADSVKGRFTISRDNAKNSLYLQMNSLRAEDTALYYCAKDITYGSGSYGAFDIWGQGTMVTVSSTSGQAGQHHHHHHGAYPYDVPDYAS

SEQ ID NO: 707 - protein, 248 aa, Artificial Sequence
  source: /note="Description of Artificial Sequence: Synthetic scFv sequence"
SYVLTQPPSVSVAPGKTARITCGGNNIGSKSVHWYQQKPGQAPVLVIYYDSDRPSGIPERFSGSNSGNTATLTISRVEAGDEADYYCQVWDSSSDHPYVFGTGTKVTVLGSRGGGGSGGGGSGGGGSLEMAQMQLVQSGAEVKKPGASVKVSCKASGYTFTSYGISWVRQAPGQGLEWMGWISAYNGNTNYAQKLQGRVTMTTDTSTSTAYMELRSLRSDDTAVYYCARSMFGAHDSWGQGTLVTVSS

SEQ ID NO: 708 - protein, 273 aa, Artificial Sequence
  source: /note="Description of Artificial Sequence: Synthetic scFv sequence"
SYVLTQPPSVSVAPGKTARITCGGNNIGSKSVHWYQQKPGQAPVLVIYYDSDRPSGIPERFSGSNSGNTATLTISRVEAGDEADYYCQVWDSSSDHPYVFGTGTKVTVLGSRGGGGSGGGGSGGGGSLEMAQMQLVQSGAEVKKPGASVKVSCKASGYTFTSYGISWVRQAPGQGLEWMGWISAYNGNTNYAQKLQGRVTMTTDTSTSTAYMELRSLRSDDTAVYYCARSMFGAHDSWGQGTLVTVSSTSGQAGQHHHHHHGAYPYDVPDYAS

SEQ ID NO: 709 - protein, 249 aa, Artificial Sequence
  source: /note="Description of Artificial Sequence: Synthetic scFv sequence"
SYVLTQPPSVSVAPGKTARITCGGNNIGSKSVHWYQQKPGQAPVLVIYYDSDRPSGIPERFSGSNSGNTATLTISRVEAGDEADYYCQVWDSSSDHYVFGTGTKVTVLGSRGGGGSGGGGSGGGGSLEMAEVQLVETGGGLVQPGGSLRLSCAASGFTFSSYAMSWVRQAPGKGLEWVSAISGSDGSTYYADSVKGRFTISRDNSKNTLYLQMNSLRDEDTAVYYCARSHEANLVGDWWGQGTLVTVSS

SEQ ID NO: 710 - protein, 274 aa, Artificial Sequence
  source: /note="Description of Artificial Sequence: Synthetic scFv sequence"
SYVLTQPPSVSVAPGKTARITCGGNNIGSKSVHWYQQKPGQAPVLVIYYDSDRPSGIPERFSGSNSGNTATLTISRVEAGDEADYYCQVWDSSSDHYVFGTGTKVTVLGSRGGGGSGGGGSGGGGSLEMAEVQLVETGGGLVQPGGSLRLSCAASGFTFSSYAMSWVRQAPGKGLEWVSAISGSDGSTYYADSVKGRFTISRDNSKNTLYLQMNSLRDEDTAVYYCARSHEANLVGDWWGQGTLVTVSSTSGQAGQHHHHHHGAYPYDVPDYAS

SEQ ID NO: 711 - protein, 244 aa, Artificial Sequence
  source: /note="Description of Artificial Sequence: Synthetic scFv sequence"
SYVLTQPPSVSVAPGKTARITCGGNNIGSKSVHWYQQKPGQAPVLVIYYDSDRPSGIPERFSGSNSGNTATLTISRVEAGDEADYYCQVWDSSSDYVFGTGTKVTVLGSRGGGGSGGGGSGGGGSLEMAEVQLVETGGGLVKPGGSLRLSCAASGFTVSDYYMSWIRQAPGKGLEWISYISGSGNSIYYADSVKGRFTISRDNAKNSLDLQMTSLRAEDTAVYYCARSTKFDYWGQGTLVTVSS

SEQ ID NO: 712 - protein, 269 aa, Artificial Sequence
  source: /note="Description of Artificial Sequence: Synthetic scFv sequence"
SYVLTQPPSVSVAPGKTARITCGGNNIGSKSVHWYQQKPGQAPVLVIYYDSDRPSGIPERFSGSNSGNTATLTISRVEAGDEADYYCQVWDSSSDYVFGTGTKVTVLGSRGGGGSGGGGSGGGGSLEMAEVQLVETGGGLVKPGGSLRLSCAASGFTVSDYYMSWIRQAPGKGLEWISYISGSGNSIYYADSVKGRFTISRDNAKNSLDLQMTSLRAEDTAVYYCARSTKFDYWGQGTLVTVSSTSGQAGQHHHHHHGAYPYDVPDYAS

SEQ ID NO: 713 - protein, 270 aa, Artificial Sequence
  source: /note="Description of Artificial Sequence: Synthetic scFv sequence"
SYVLTQPPSVSVAPGKTARITCGGNNIGSKSVHWYQQKPGQAPVLVVYDDSDRPSGIPERFSGSNSGNTATLSISRVEAGDEADYYCQVWDSSSDHTVFGTGTKVTVLGSRGGGGSGGGGSGGGGSLEMAQVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARYYPGMDMWGQGTLVTVSSTSGQAGQHHHHHHGAYPYDVPDYAS

SEQ ID NO: 714 - protein, 244 aa, Artificial Sequence
  source: /note="Description of Artificial Sequence: Synthetic scFv sequence"
SYVLTQPPSVSVAPGKTARITCGGNNIGSKSVHWYQQKPGQAPVLVVYDDSDRPSGIPERFSGSNSGNTATLSISRVEAGDEADYYCQVWDSSSDHTVFGTGTKVTVLGSRGGGGSGGGGSGGGGSLEMAQVQLQQWGAGLLKPSETLSLTCAVYGGSFSGYYWSWIRQPPGKGLEWIGEINHSGSTNYNPSLKSRVTISVDTSKNQFSLLSSVTAADTAVYYCARYYPGMDMWGQGTLVTVSS

SEQ ID NO: 715 - protein, 248 aa, Artificial Sequence
  source: /note="Description of Artificial Sequence: Synthetic scFv sequence"
SYVLTQPPSVSVAPGKTARITCGGNNIGSKSVHWYQQKPGQAPVVVIHYDSDRPSGIPERFSGSNSGNTATLTISRVEAGDEADYYCQVWDSSSDHPYVFGTGTKVTVLGSRGGGGSGGGGSGGGGSLEMAEVQLVQSGAEVKKPGASVKVSCKASGYTFTTYGISWVRQAPGQGLEWMGWINTYNGHTNYAQKLQGRATMTADTSTNTAYMELRSLRSDDTAVYYCARVIYGSGDYWGQGTLVTVSS

SEQ ID NO: 716 - protein, 273 aa, Artificial Sequence
  source: /note="Description of Artificial Sequence: Synthetic scFv sequence"
SYVLTQPPSVSVAPGKTARITCGGNNIGSKSVHWYQQKPGQAPVVVIHYDSDRPSGIPERFSGSNSGNTATLTISRVEAGDEADYYCQVWDSSSDHPYVFGTGTKVTVLGSRGGGGSGGGGSGGGGSLEMAEVQLVQSGAEVKKPGASVKVSCKASGYTFTTYGISWVRQAPGQGLEWMGWINTYNGHTNYAQKLQGRATMTADTSTNTAYMELRSLRSDDTAVYYCARVIYGSGDYWGQGTLVTVSSTSGQAGQHHHHHHGAYPYDVPDYAS

SEQ ID NO: 717 - protein, 251 aa, Artificial Sequence
  source: /note="Description of Artificial Sequence: Synthetic scFv sequence"
SYVLTQPPSVSVSPGQTASITCSGDRLTNKYVSWYQQKPGQSPVLVIYEDAKRPSGIPARFSGSNSGNTATLTISGTQAMDESEYYCQAWDSSVVVFGGGTKLTVLGSRGGGGSGGGGSGGGGSLEMAEVQLVESGGGLVQPGRSLRLSCAASGFTFDDYAMHWVRQAPGKGLEWVSGISWNSGSIGYADSVKGRFTISRDNAKNSLYLQMNSLRDEDTALYYCAKDRGGGVIVKDAFDIWGQGTMVTVSS

SEQ ID NO: 718 - protein, 276 aa, Artificial Sequence
  source: /note="Description of Artificial Sequence: Synthetic scFv sequence"
SYVLTQPPSVSVSPGQTASITCSGDRLTNKYVSWYQQKPGQSPVLVIYEDAKRPSGIPARFSGSNSGNTATLTISGTQAMDESEYYCQAWDSSVVVFGGGTKLTVLGSRGGGGSGGGGSGGGGSLEMAEVQLVESGGGLVQPGRSLRLSCAASGFTFDDYAMHWVRQAPGKGLEWVSGISWNSGSIGYADSVKGRFTISRDNAKNSLYLQMNSLRDEDTALYYCAKDRGGGVIVKDAFDIWGQGTMVTVSSTSGQAGQHHHHHHGAYPYDVPDYAS

SEQ ID NO: 719 - protein, 256 aa, Artificial Sequence
  source: /note="Description of Artificial Sequence: Synthetic scFv sequence"
SRAAQPAMAQVQLQQSGAELVKPGASVKISCKASGYSFTGYFMNWVKQSHGKSLEWIGRIHPYDGDTFYNQNFKDKATLTVDKSSNTAHMELLSLTSEDFAVYYCTRYDGSRAMDYWGQGTTVTVSSGGGGSGGGGSGGGGSDIELTQSPASLAVSLGQRAIISCKASQSVSFAGTSLMHWYHQKPGQQPKLLIYRASNLEAGVPTRFSGSGSKTDFTLNIHPVEEEDAATYYCQQSREYPYTFGGGTKLEIKRAA

SEQ ID NO: 720 - protein, 504 aa, Artificial Sequence
  source: /note="Description of Artificial Sequence: Synthetic scFv sequence"
QVQLQESGPGLVKPSQTLSLTCTVSGGSISSGAYYWTWIRQHPGKGLEWIGYIYYSGSTYYNPSLKSRVSISIDTSKNQFSLKLSSVTAADTAVYYCARGSSSWFDYWGQGTLVTVSSGGGGSGGGGSGGGGSQSVLTQPPSVSEAPRQRVTISCSGSSSNIGNNAVNWYQQLPGKAPKLLIYYDDMLSSGVSDRFSGSKSGTSASLAISGLQSEDEADYYCAAWDDSLNGVVFGGGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLHHHHHH

SEQ ID NO: 721 - protein, 225 aa, Artificial Sequence
  source: /note="Description of Artificial Sequence: Synthetic scFv sequence"
EVQLQQSGPELVKPGASVKISCKASGYTFTDYYMNWVKQSHGKSLEWIGDINPNNGGTSYNQKFKGKATLTVDKSSSTAYMELRSLTSEDSAVYYCATYGLGGYWGQGTTLTVSSGNIVMTQSPKSMSMSVGERVTLTCKASENVVTYVSWYQQKPEQSPKLLIYGASNRYTGVPDRFTGSGSATDFTLTISSVQAEDLADYHCGQGYSYPYTFGGGTKLEVKKA

SEQ ID NO: 722 - protein, 248 aa, Artificial Sequence
  source: /note="Description of Artificial Sequence: Synthetic scFv sequence"
HMQVQLQQPGAELVKPGASVKLSCKASGYTFTRYWMHWVRQRPGQGLEWIGEINPMDSRTNYNKKFKSKATLTVDKSSSTAYMQLSSLKSEDSAVYYCARPGRARGMDYWGQGNSVTVSSGGGGSGGGGSGGGGSGNIVLTQSPASLAVSLGQRAIISCLYGESVESYGNNFMHWYQQKPGQAPKLLIYLASNLESGVPARFSGSGSRTDFTLTIDPVEADDAATYYCQQNNEDPTFGGGTKLEIKKA

SEQ ID NO: 723 - protein, 244 aa, Artificial Sequence
  source: /note="Description of Artificial Sequence: Synthetic scFv sequence"
MEVQLVESGGGLVKPGGSLKLSCAASGFTFSSYAMSWARQTPEKRLEWVATISDGGYYTYYPDNVKGRFTISRDNAKNNLYLQMSHLKSGDTAMYYCARYDSFDYWGQGTTLTVSSGGGGSGGGGSRGGGSGDIVLTQSPASLAVSLGQRATISYRASKSVSTSGYSYMHWNQQKPGQPPRLLIYLVSNLESGVPARFSGSGSGTDFTLNIHPVEEEDAATYYCQHIRELTTFGGGTKLEIKKA

SEQ ID NO: 724 - protein, 230 aa, Artificial Sequence
  source: /note="Description of Artificial Sequence: Synthetic scFv sequence"
MQVQLQQPGAELVKPGASVKLSCKASGYTFTRYWMHWVRQRPGQGLEWIGEINPSNGRTNYNEKFKSKATLTVDKSSSTAYMQLSSLKSEDSAVYYCARPGRARGMDYWGQGNSVTVSSGNIVLTQSPASLAVSLGQRATISCRASESVESYGNNFMHWYQQKPGQAPKLLIYLASNLESGVPARFSGSGSRTDFTLTIDPVEADDAATYYCQQNNEDPTFGGGTKLEIK

SEQ ID NO: 725 - protein, 237 aa, Artificial Sequence
  source: /note="Description of Artificial Sequence: Synthetic scFv sequence"
QAVVTQEPSLTVSPGGTVTLTCGSSTGAVTTSNYASWVQQKPDHLFRGLIGGTNNRAPGVPARFSGSLLGGKAALTISGAQPEDEAEYYCVLWYSDHWVFGGGTKLTVLGGGGSGGGGSGGGGSQVQLQESGPGLVKPSETLSITCTVSGFLLTDYGVNWVRQPPGKGLEWLGVLWGDGITDYNPSLKSRLTVSKDTSKNQVSLKMSSLTAADTAVYYCVTGLFDYWGQGTLLTVSS

SEQ ID NO: 726 - protein, 237 aa, Artificial Sequence
  source: /note="Description of Artificial Sequence: Synthetic scFv sequence"
QAVVTQEPSLTVSPGGTVTLTCGSSTGAVTTSNYASWVQQKPDHLFRGLIGGTNNRAPGVPARFSGSLLGGKAALTISGAQPEDEAEYYCVLWYSDHWVFGGGTKLTVLGGGGSGGGGSGGGGSQVQLQESGPGLVKPSETLSLTCTVSGFLLTDYGVNWLRQPPGKGLEWIGVLWGDGITDYNPSLKSRVTISKDTSKNQFSLKLSSVTAADTAVYYCVTGLFDYWGQGTLVTVSS

SEQ ID NO: 727 - protein, 237 aa, Artificial Sequence
  source: /note="Description of Artificial Sequence: Synthetic scFv sequence"
QAVVTQEPSLTVSPGGTVTLTCGSSTGAVTTSNYASWVQQKPGQAFRGLIGGTNNRAPGVPARFSGSLLGGKAALTISGAQPEDEAEYYCVLWYSDHWVFGGGTKLTVLGGGGSGGGGSGGGGSQVQLQESGPGLVKPSETLSITCTVSGFLLTDYGVNWVRQPPGKGLEWLGVLWGDGITDYNPSLKSRLTVSKDTSKNQVSLKMSSLTAADTAVYYCVTGLFDYWGQGTLLTVSS

SEQ ID NO: 728 - protein, 237 aa, Artificial Sequence
  source: /note="Description of Artificial Sequence: Synthetic scFv sequence"
QAVVTQEPSLTVSPGGTVTLTCGSSTGAVTTSNYASWVQQKPGQAFRGLIGGTNNRAPGVPARFSGSLLGGKAALTISGAQPEDEAEYYCVLWYSDHWVFGGGTKLTVLGGGGSGGGGSGGGGSQVQLQESGPGLVKPSETLSLTCTVSGFLLTDYGVNWLRQPPGKGLEWIGVLWGDGITDYNPSLKSRVTISKDTSKNQFSLKLSSVTAADTAVYYCVTGLFDYWGQGTLVTVSS

SEQ ID NO: 729 - protein, 237 aa, Artificial Sequence
  source: /note="Description of Artificial Sequence: Synthetic scFv sequence"
QAVVTQEPSLTVSPGGTVTLTCGSSTGAVTTSNYASWVQQKPGQAPRGLIGGTNNRAPGVPARFSGSLLGGKAALTISGAQPEDEAEYYCVLWYSDHWVFGGGTKLTVLGGGGSGGGGSGGGGSQVQLQESGPGLVKPSETLSITCTVSGFLLTDYGVNWVRQPPGKGLEWLGVLWGDGITDYNPSLKSRLTVSKDTSKNQVSLKMSSLTAADTAVYYCVTGLFDYWGQGTLLTVSS

SEQ ID NO: 730 - protein, 237 aa, Artificial Sequence
  source: /note="Description of Artificial Sequence: Synthetic scFv sequence"
QAVVTQEPSLTVSPGGTVTLTCGSSTGAVTTSNYASWVQQKPGQAPRGLIGGTNNRAPGVPARFSGSLLGGKAALTISGAQPEDEAEYYCVLWYSDHWVFGGGTKLTVLGGGGSGGGGSGGGGSQVQLQESGPGLVKPSETLSLTCTVSGFLLTDYGVNWLRQPPGKGLEWIGVLWGDGITDYNPSLKSRVTISKDTSKNQFSLKLSSVTAADTAVYYCVTGLFDYWGQGTLVTVSS

SEQ ID NO: 731 - protein, 239 aa, Artificial Sequence
  source: /note="Description of Artificial Sequence: Synthetic scFv sequence"
EIVMTQTPATLSVSAGERVTITCKASQSVSNDVTWYQQKPGQAPRLLIYSASNRYSGVPARFSGSGYGTEFTFTISSVQSEDFAVYFCQQDYSSFGQGTKLEIKRGGGGSGGGGSGGGGSQVQLVESGPGVVQPGRSLRISCAVSGFSVTNYGVHWVRQPPGKGLEWLGVIWAIGITNYNSAFMSRLTISKDNSKNTVYLQMNSLRAEDTAMYYCASRGGHYGYALDYWGQGTLVTVSS

SEQ ID NO: 732 - protein, 524 aa, Artificial Sequence
  source: /note="Description of Artificial Sequence: Synthetic scFv sequence"
EIVMTQTPATLSVSAGERVTITCKASQSVSNDVTWYQQKPGQAPRLLIYSASNRYSGVPARFSGSGYGTEFTFTISSVQSEDFAVYFCQQDYSSFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECGGGGSGGGGSASHVKLQESGPLTLSKADYEKHKVYACEVTHQGLSSPVTKSFNRGECGGGGSGGGGSASHVKLQESGPGLVQPSQSLSLTCTVSGFSLTDYGVHWVRQSPGKGLEWLGVIWSGGGTAYNTALISRLNIYRDNSKNQVFLEMNSLQAEDTAMYYCARRGSYPYNYFDAWGCGTTVTVSSGGGGSGGGGSGGGGSQAVVIQESALTTPPGETVTLTCGSSTGAVTASNYANWVQEKPDHCFTGLIGGHNNRPPGVPARFSGSLIGDKAALTIAGTQTEDEAIYFCALWYSDHWVIGGGTRLTVLG

SEQ ID NO: 733 - protein, 518 aa, Artificial Sequence
  source: /note="Description of Artificial Sequence: Synthetic scFv sequence"
EIVMTQTPATLSVSAGERVTITCKASQSVSNDVTWYQQKPGQAPRLLIYSASNRYSGVPARFSGSGYGTEFTFTISSVQSEDFAVYFCQQDYSSFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECGGGGSGGGGSQVQLVQSGGGLTLSKADYEKHKVYACEVTHQGLSSPVTKSFNRGECGGGGSGGGGSQVQLVQSGGGVVQPGRSLRLSCKASGYTFTRYTMHWVRQAPGKCLEWIGYINPSRGYTNYNQKFKDRFTISRDNSKNTAFLQMDSLRPEDTGVYFCARYYDDHYCLDYWGQGTPVTVSSGGGGSGGGGSGGGGSDIQMTQSPSSLSASVGDRVTITCSASSSVSYMNWYQQTPGKAPKRWIYDTSKLASGVPSRFSGSGSGTDYTFTISSLQPEDIATYYCQQWSSNPFTFGCGTKLQITR

SEQ ID NO: 734 - protein, 239 aa, Artificial Sequence
  source: /note="Description of Artificial Sequence: Synthetic scFv sequence"
EIVMTQTPATLSVSAGERVTITCKASQSVSNHVTWYQQKPGQAPRLLIYSASNRYSGVPARFSGSGYGTEFTFTISSVQSEDFAVYFCQQDYSSFGQGTKLEIKRGGGGSGGGGSGGGGSQVQLVESGPGVVQPGRSLRISCAVSGFSVTNYGVHWVRQPPGKGLEWLGVIWAGGITNYNSAFMSRLTISKDNSKNTVYLQMNSLRAEDTAMYYCASRGGHYGYALDYWGQGTLVTVSS

SEQ ID NO: 735 - protein, 239 aa, Artificial Sequence
  source: /note="Description of Artificial Sequence: Synthetic scFv sequence"
EIVMTQTPATLSVSAGERVTITCKASQSVSNHVTWYQQKPGQAPRLLIYSASNRYSGVPARFSGSGYGTEFTFTISSVQSEDFAVYFCQQDYSSFGQGTKLEIKRGGGGSGGGGSGGGGSQVQLVESGPGVVQPGRSLRISCAVSGFSVTNYGVHWVRQPPGKGLEWLGVIWAIGITNYNSAFMSRLTISKDNSKNTVYLQMNSLRAEDTAMYYCASRGGHYGYALDYWGQGTLVTVSS

SEQ ID NO: 736 - protein, 239 aa, Artificial Sequence
  source: /note="Description of Artificial Sequence: Synthetic scFv sequence"
EIVMTQTPATLSVSAGERVTITCRASQSVSNDVTWYQQKPGQAPRLLIYSASNRYTGIPARFSGSGYGTEFTFTISSVQSEDFAVYFCQQDYSSFGQGTKLEIKRGGGGSGGGGSGGGGSQVQLVESGPGVVQPGRSLRLSCAVSGFSVTNYGVHWVRQPPGKGLEWLGVIWAGGITNYNSSVKGRLTISKDNSKNTVYLQMNSLRAEDTAVYYCASRGGHYGYALDYWGQGTLVTVSS

SEQ ID NO: 737 - protein, 239 aa, Artificial Sequence
  source: /note="Description of Artificial Sequence: Synthetic scFv sequence"
EIVMTQTPATLSVSAGERVTITCRASQSVSNDVTWYQQKPGQAPRLLIYSASNRYTGIPARFSGSGYGTEFTFTISSVQSEDFAVYFCQQDYSSFGQGTKLEIKRGGGGSGGGGSGGGGSQVQLVESGPGVVQPGRSLRLSCAVSGFSVTNYGVHWVRQPPGKGLEWLGVIWAIGITNYNSSVKGRLTISKDNSKNTVYLQMNSLRAEDTAVYYCASRGGHYGYALDYWGQGTLVTVSS

SEQ ID NO: 738 - protein, 239 aa, Artificial Sequence
  source: /note="Description of Artificial Sequence: Synthetic scFv sequence"
EIVMTQTPATLSVSAGERVTITCRASQSVSNHVTWYQQKPGQAPRLLIYSASNRYTGIPARFSGSGYGTEFTFTISSVQSEDFAVYFCQQDYSSFGQGTKLEIKRGGGGSGGGGSGGGGSQVQLVESGPGVVQPGRSLRLSCAVSGFSVTNYGVHWVRQPPGKGLEWLGVIWAGGITNYNSSVKGRLTISKDNSKNTVYLQMNSLRAEDTAVYYCASRGGHYGYALDYWGQGTLVTVSS

SEQ ID NO: 739 - protein, 239 aa, Artificial Sequence
  source: /note="Description of Artificial Sequence: Synthetic scFv sequence"
EIVMTQTPATLSVSAGERVTITCRASQSVSNHVTWYQQKPGQAPRLLIYSASNRYTGIPARFSGSGYGTEFTFTISSVQSEDFAVYFCQQDYSSFGQGTKLEIKRGGGGSGGGGSGGGGSQVQLVESGPGVVQPGRSLRLSCAVSGFSVTNYGVHWVRQPPGKGLEWLGVIWAIGITNYNSSVKGRLTISKDNSKNTVYLQMNSLRAEDTAVYYCASRGGHYGYALDYWGQGTLVTVSS

SEQ ID NO: 740 - protein, 249 aa, Artificial Sequence
  source: /note="Description of Artificial Sequence: Synthetic scFv sequence"
EVKLVESGGGLVLPGDSLRLSCATSEFTFTDYYMTWVRQPPRKALEWLGFIRNRANGYTTEYNPSVKGRFTISRDNSQSILYLQMNTLRTEDSATYYCARVSNWAFDYWGQGTTLTVSSGSTSGSGKPGSSEGSTKGDVVMTQTPLSLPVSLGDQASISCRSSQSLLKNNGNTFLHWYLQKSGQSPKLLIYKVSNRLSGVPDRFSGSGSGTYFTLKISRVEAEDLGVYFCSQSTHIPYTFGGGTKLEIK

SEQ ID NO: 741 - protein, 244 aa, Artificial Sequence
  source: /note="Description of Artificial Sequence: Synthetic scFv sequence"
EVQLVQSGAEVEKPGASVKISCKASGSSFTGYNMNWVRQNIGKSLEWIGAIDPYYGGTSYNQKFKGRATLTVDKSTSTAYMHLKSLRSEDTAVYYCVSGMEYWGQGTSVTVSSGSTSGSGKPGSSEGSTKGDVVMTQTPLSLPVTPGEPASISCRSSQSLVHRNGNTYLHWYLQKPGQSPKLLIHKVSNRFSGVPDRFSGSGSGTDFTLKISRVEAEDLGVYFCSQSTHVPPLTFGAGTKLELK

SEQ ID NO: 742 - protein, 239 aa, Artificial Sequence
  source: /note="Description of Artificial Sequence: Synthetic scFv sequence"
KIVMTQTPATLSVSAGERVTITCKASQSVSNDVTWYQQKPGQAPRLLIYSASNRYSGVPARFSGSGYGTEFTFTISSVQSEDFAVYFCQQDYSSFGQGTKLEIKRGGGGSGGGGSGGGGSQVQLVESGPGVVQPGRSLRISCAVSGFSVTNYGVHWVRQPPGKGLEWLGVIWAGGITNYNSAFMSRLTISKDNSKNTVYLQMNSLRAEDTAMYYCASRGGHYGYALDYWGQGTLVTVSS

SEQ ID NO: 743 - protein, 239 aa, Artificial Sequence
  source: /note="Description of Artificial Sequence: Synthetic scFv sequence"
KIVMTQTPATLSVSAGERVTITCKASQSVSNDVTWYQQKPGQAPRLLIYSASNRYSGVPARFSGSGYGTEFTFTISSVQSEDFAVYFCQQDYSSFGQGTKLEIKRGGGGSGGGGSGGGGSQVQLVESGPGVVQPGRSLRISCAVSGFSVTNYGVHWVRQPPGKGLEWLGVIWAIGITNYNSAFMSRLTISKDNSKNTVYLQMNSLRAEDTAMYYCASRGGHYGYALDYWGQGTLVTVSS

SEQ ID NO: 744 - protein, 239 aa, Artificial Sequence
  source: /note="Description of Artificial Sequence: Synthetic scFv sequence"
KIVMTQTPATLSVSAGERVTITCKASQSVSNHVTWYQQKPGQAPRLLIYSASNRYSGVPARFSGSGYGTEFTFTISSVQSEDFAVYFCQQDYSSFGQGTKLEIKRGGGGSGGGGSGGGGSQVQLVESGPGVVQPGRSLRISCAVSGFSVTNYGVHWVRQPPGKGLEWLGVIWAGGITNYNSAFMSRLTISKDNSKNTVYLQMNSLRAEDTAMYYCASRGGHYGYALDYWGQGTLVTVSS

SEQ ID NO: 745 - protein, 239 aa, Artificial Sequence
  source: /note="Description of Artificial Sequence: Synthetic scFv sequence"
KIVMTQTPATLSVSAGERVTITCKASQSVSNHVTWYQQKPGQAPRLLIYSASNRYSGVPARFSGSGYGTEFTFTISSVQSEDFAVYFCQQDYSSFGQGTKLEIKRGGGGSGGGGSGGGGSQVQLVESGPGVVQPGRSLRISCAVSGFSVTNYGVHWVRQPPGKGLEWLGVIWAIGITNYNSAFMSRLTISKDNSKNTVYLQMNSLRAEDTAMYYCASRGGHYGYALDYWGQGTLVTVSS

SEQ ID NO: 746 - protein, 239 aa, Artificial Sequence
  source: /note="Description of Artificial Sequence: Synthetic scFv sequence"
KIVMTQTPATLSVSAGERVTITCRASQSVSNDVTWYQQKPGQAPRLLIYSASNRYTGIPARFSGSGYGTEFTFTISSVQSEDFAVYFCQQDYSSFGQGTKLEIKRGGGGSGGGGSGGGGSQVQLVESGPGVVQPGRSLRLSCAVSGFSVTNYGVHWVRQPPGKGLEWLGVIWAGGITNYNSSVKGRLTISKDNSKNTVYLQMNSLRAEDTAVYYCASRGGHYGYALDYWGQGTLVTVSS

SEQ ID NO: 747 - protein, 239 aa, Artificial Sequence
  source: /note="Description of Artificial Sequence: Synthetic scFv sequence"
KIVMTQTPATLSVSAGERVTITCRASQSVSNDVTWYQQKPGQAPRLLIYSASNRYTGIPARFSGSGYGTEFTFTISSVQSEDFAVYFCQQDYSSFGQGTKLEIKRGGGGSGGGGSGGGGSQVQLVESGPGVVQPGRSLRLSCAVSGFSVTNYGVHWVRQPPGKGLEWLGVIWAIGITNYNSSVKGRLTISKDNSKNTVYLQMNSLRAEDTAVYYCASRGGHYGYALDYWGQGTLVTVSS

SEQ ID NO: 748 - protein, 100 aa, Artificial Sequence
  source: /note="Description of Artificial Sequence: Synthetic scFv sequence"
KIVMTQTPATLSVSAGERVTITCRASQSVSNHVTWYQQKPGQAPRLLIYSASNRYTGIPARFSGSGYGTEFTFTISSVQSEDFAVYFCQQDYSSFGQGTK

SEQ ID NO: 749 - protein, 239 aa, Artificial Sequence
  source: /note="Description of Artificial Sequence: Synthetic scFv sequence"
KIVMTQTPATLSVSAGERVTITCRASQSVSNHVTWYQQKPGQAPRLLIYSASNRYTGIPARFSGSGYGTEFTFTISSVQSEDFAVYFCQQDYSSFGQGTKLEIKRGGGGSGGGGSGGGGSQVQLVESGPGVVQPGRSLRLSCAVSGFSVTNYGVHWVRQPPGKGLEWLGVIWAGGITNYNSSVKGRLTISKDNSKNTVYLQMNSLRAEDTAVYYCASRGGHYGYALDYWGQGTLVTVSS

SEQ ID NO: 750 - protein, 139 aa, Artificial Sequence
  source: /note="Description of Artificial Sequence: Synthetic scFv sequence"
LEIKRGGGGSGGGGSGGGGSQVQLVESGPGVVQPGRSLRLSCAVSGFSVTNYGVHWVRQPPGKGLEWLGVIWAIGITNYNSSVKGRLTISKDNSKNTVYLQMNSLRAEDTAVYYCASRGGHYGYALDYWGQGTLVTVSS

SEQ ID NO: 751 - protein, 243 aa, Artificial Sequence
  source: /note="Description of Artificial Sequence: Synthetic scFv sequence"
QVQLKESGPVLVAPSQTLSITCTVSGFSLASYNIHVWRQPPGKGLEWLGVIWAGGSTNYNSALMSRLSISKDNSKSQVFLQMNSLQTDDTAMYYCAKRSDDYSWFAYWGQGTLVTVSASGGGGSGGGGSGGGGSENVLTQSPAIMSASPGEKVTMTCRASSSVSSSYLHWYQQKSGASPKVWIYSTSNLASGVPGRFSGSGSGTSYSLTISSVEAEDAATYYCQQYSGYPITFGAGTKVEVKR

SEQ ID NO: 752 - protein, 243 aa, Artificial Sequence
  source: /note="Description of Artificial Sequence: Synthetic scFv sequence"
QVQLKESGPVLVAPSQTLSITCTVSGFSLASYNIHWVRQPPGKGLEWLGVIWAGGSTNYNSALMSRLSISKDNSKSQVFLQMNSLQTDDTAMYYCAKRSDDYSWFAYWGQGTLVTVSASGGGGSGGGGSGGGGSENVLTQSPAIMSASPGEKVTMTCRASSSVSSSYLHWYQQKSGASPKVWIYSTSNLASGVPGRFSGSGSGTSYSLTISSVEAEDAATYYCQQYSGYPITFGAGTKVEVKR

SEQ ID NO: 753 - protein, 242 aa, Artificial Sequence
  source: /note="Description of Artificial Sequence: Synthetic scFv sequence"
QVQLQESGPGLVKPSQTLSITCTVSGFSLASYNIHWVRQPPGKGLEWLGVIWAGGSTNYNSALMSRLTISKDNSKNQVFLKMSSLTAADTAVYYCAKRSDDYSWFAYWGQGTLVTVSSGGGGSGGGGSGGGGSENQMTQSPSSLSASVGDRVTMTCRASSSVSSSYLHWYQQKSGKAPKVWIYSTSNLASGVPSRFSGSGSGTDYTLTISSLQPEDFATYYCQQYSGYPITFGQGTKVEIKR

SEQ ID NO: 754 - protein, 241 aa, Artificial Sequence
  source: /note="Description of Artificial Sequence: Synthetic scFv sequence"
QVQLQESGPGLVKPSQTLSITCTVSGFSLASYNIHWVRQPPGKGLEWLGVIWAGGSTNYNSALMSRLTISKDNSKNQVFLKMSSLTAADTAVYYCAKRSDDYSWFAYWGQTLVTVSSGGGGSGGGGSGGGGSENQMTQSPSSLSASVGDRVTMTCRASSSVSSSYLHWYQQKSGKAPKVWIYSTSNLASGVPSRFSGSGSGTDYTLTISSLQPEDFATYYCQQYSGYPITFGQGTKVEIKR

SEQ ID NO: 755 - protein, 241 aa, Artificial Sequence
  source: /note="Description of Artificial Sequence: Synthetic scFv sequence"
QVQLVESGPGVVQPGRSLRISCAVSGFSVTNYGVHWVRQPPGKGLEWLGVIWAGGITNYNSAFMSRLTISKDNSKNTVYLQMNSLRAEDTAMYYCASRGGHYGYALDYWGQGTLVTVSSGSTSGSGKPGSSEGSTKGEIVMTQTPATLSVSAGERVTITCKASQSVSNDVTWYQQKPGQAPRLLIYSASNRYSGVPARFSGSGYGTEFTFTISSVQSEDFAVYFCQQDYSSFGQGTKLEIK

SEQ ID NO: 756 - protein, 239 aa, Artificial Sequence
  source: /note="Description of Artificial Sequence: Synthetic scFv sequence"
EVQLLESGGGLVQPGGSLRLSCAASGFTFSSYAMSWVRQAPGKGLEWVSTIQKQGLPTEYADSVKGRFTISRDNSKNTLYLQMNSLRAEDTAVYYCAKNRAKFDYWGQGTLVTVSSGGGGSGGGGSGGGGSTDIQMTQSPSSLSASVGDRVTITCRASQSISSYLNWYQQKPGKAPKLLIYNASMLQSGVPSRFSGSGSGTDFTLTISSLQPEDFATYYCQQNRGFPLTFGQGTKVEIK

SEQ ID NO: 757 - protein, 261 aa, Artificial Sequence
  source: /note="Description of Artificial Sequence: Synthetic scFv sequence"
MDWIWRILFLVGAATGAHSQVQLQQSGAELVRPGASVKLSCKASGYTFTDYEMHWVKQTPVHGLKWIGALDPKTGDTAYSQKFKGKATLTADKSSSTAYMELRSLTSEDSAVYYCTRFYSYTYWGQGTLVTVSAGGGGSGGGGSGGGGSDVVMTQTPLSLPVSLGDQASISCRSSQSLVHSNGNTYLHWYLQKPGQSPKLLIYKVSNRFSGVPDRFSGSGSGTDFTLKISRVEAEDLGVYFCSQNTHVPPTFGSGTKLEIK

SEQ ID NO: 758 - protein, 242 aa, Artificial Sequence
  source: /note="Description of Artificial Sequence: Synthetic scFv sequence"
QVQLQQSGAELVRPGASVKLSCKASGYTFTDYEMHWVKQTPVHGLKWIGALDPKTGDTAYSQKFKGKATLTADKSSSTAYMELRSLTSEDSAVYYCTRFYSYTYWGQGTLVTVSAGGGGSGGGGSGGGGSDVVMTQTPLSLPVSLGDQASISCRSSQSLVHSNGNTYLHWYLQKPGQSPKLLIYKVSNRFSGVPDRFSGSGSGTDFTLKISRVEAEDLGVYFCSQNTHVPPTFGSGTKLEIK

SEQ ID NO: 759 - protein, 248 aa, Artificial Sequence
  source: /note="Description of Artificial Sequence: Synthetic scFv sequence"
DIQLTQSPSSLSASVGDRVTITCRASQSISSYLNWYQQKPGKAPKLLIYAASSLQSGVPSRFSGSGSGTDFTLTISSLQPADFATYYCQQSYSVPYTFGQGTKLEIKRSRGGGGSGGGGSGGGGSLEMAEVQLVQSGGGLVQPGGSLRLSCATSGFTFNNYWMSWVRQAPGKGLEWVANIKQDGSEKYYADSVRGRFTISRDNAKNSLSLQLNNLRAEDTAVYYCARSMSTAWGYDEWGQGTLVTVSS

SEQ ID NO: 760 - protein, 269 aa, Artificial Sequence
  source: /note="Description of Artificial Sequence: Synthetic scFv sequence"
MKKTAIAIAVALAGFATVAQAAELQAVLTQPPSASGTPGQRVTISCSGSSSNIGSNYVYWYQQLPGTAPKLLIYRNNQRPSGVPDRFSGSKSGTSASLAISGLRSEDEADYYCAAWDDSLSGRVFGTGTKVTVLGSRGGGGSGGGGSGGGGSLEMAQLQLVQSGAEVKKPGSSVKVSCKASGYTFNTYYLHWVRQAPGQGLEWMGRINPNNGGTNYAQKFQGRVTMTRDTSINTAYMELSRLRSDDTAVYYCARSYDYWGQGTLVTVSS

SEQ ID NO: 761 - protein, 276 aa, Artificial Sequence
  source: /note="Description of Artificial Sequence: Synthetic scFv sequence"
MKKTAIAIAVALAGFATVAQAAELQPVLTQPPSASGTPGQRVTISCSGSSSNIGGNTVSWYQQVPGTAPRLLIFRNNQRPPGVPDRFSGSKSGTSASLAISGLRSEDEADYYCAAWDASRQGVFGGGTKLTVLGSRGGGGSGGGGSGGGGSLEMAQVQLVQSGAEVKKPGSSVKVSCKASGGTFRSYAITWVRQAPGQGLEWMGRIIPMLDITNYAQKFQGRVTITADKSTSTAYMELSSLRSEDTAVYYCARTYSRSPFHMEDFWGQGTLVTVSS

SEQ ID NO: 762 - protein, 271 aa, Artificial Sequence
  source: /note="Description of Artificial Sequence: Synthetic scFv sequence"
MKKTAIAIAVALAGFATVAQAAELQSALTQPPSASGSPGQSVTISCTGTSRDAGGYNYFSWYQQHPGKAPKLLIYEVTKRPSGVPDRFSGSKSGKTASLTVSGLQADDEAVYYCSSYGGSNNFRVFGGGTKLTVLGSRGGGGSGGGGSGGGGSLEMAEVQLVESGGGVVRPGGSLRLSCAASGFTFGDYGMSWVRQAPGKGLEWVSGINWNGGSTGYADSVKGRFTISRDNAKNSLYLQMNSLRAEDTAVYYCARSKQDYWGQGTLVTVSS

SEQ ID NO: 763 - protein, 273 aa, Artificial Sequence
  source: /note="Description of Artificial Sequence: Synthetic scFv sequence"
MKKTAIAIAVALAGFATVAQAAELQSVLTQPPSASGSPGQSLTISCTGTSSDVGGYNHVSWYQQYPGKAPKLMIYEVTKRPSGVPDRFSGSKSGNTASLTVSGLQAEDEADYYCSSYAGSAHWVFGGGTKLTVLGSRGGGGSGGGGSGGGGSLEMAEVQLVQSGAEVKKPGASVKVSCKASGYTFSRYYIHWVRQAPGQGLEWMGWMNPNSGNTGYAQKFQGRVTMTRNTSISTAYMELSSLRSEDTAVYYCARGRYHVIDYWGQGTLVTVSS

SEQ ID NO: 764 - protein, 270 aa, Artificial Sequence
  source: /note="Description of Artificial Sequence: Synthetic scFv sequence"
MKKTAIAIAVALAGFATVAQAAELQSVLTQPPSASGTPGQRVTISCSGSSSNIGSNTVNWYQQLPGTAPKLLIYRNNQRPSGVPDRFSGSKSGTSASLAISGLRSEDEADYYCAAWDDSLSGRVFGGGTKLTVLGSRGGGGSGGGGSGGGGSLEMAEVQLVESGGGLVQPGGSLRLSCAASGFTFSSYAMSWVRQAPGKGLEWVSAISGSGGSTYYADSVKGRFTISRDNAKNTLYLQMNSLRAEDTAVYYCARKYQDVWGQGTLVTVSS

SEQ ID NO: 765 - protein, 279 aa, Artificial Sequence
  source: /note="Description of Artificial Sequence: Synthetic scFv sequence"
MKKTAIAIAVALAGFATVAQAAELQSVLTQPPSVSGAPGQRVTISCTGSSSNIGAGYDVHWYQQLPGRAPKLLIYGNSNRPSGVPDRFSGSKSGTSASLAITGLQAEDEADYYCQSYDSSLRGYVFGTGTKVTVLGSRGGGGSGGGGSGGGGSLEMAQVQLVQSGGGVVQPGRSLRLSCAASGFSFSGTAMHWVRQAPGKGLEWVSTISSTGRSTYYRDSVKGRFTISRDNSKNTLYLQMNSLRGEDTAVYYCARPVSSMTLSIQSDGWGQGTLVTVSS

SEQ ID NO: 766 - protein, 286 aa, Artificial Sequence
  source: /note="Description of Artificial Sequence: Synthetic scFv sequence"
MKKTAIAIAVALAGFATVAQAAELQSVVTQPPSVSAAPGQRVTISCSGGSSNIGNNYVSWFQQLPRTAPKLLIYDNNKRPSGIPDRFSGSKSGTSAALDITVLQTGDEADYYCGTWDSSLRNWVFGGGTKLTVLGSRGGGGSGGGGSGGGGSLEMAQMQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCARGQKYHSQYSRGGTGGGMTQDMWGQGTLVTVSS

SEQ ID NO: 767 - protein, 277 aa, Artificial Sequence
  source: /note="Description of Artificial Sequence: Synthetic scFv sequence"
MKKTAIAIAVALAGFATVAQAAELSYELTQPPSASGTPGQRVSISCSGSSSNIGSNTVNWYQQFPGTAPKLLIHSNNQRPSGVPDRFSGSKSGTSASLAISGPQSEDEADYYCAAWDDSVNGYVFGTGTKVTVLGSRGGGGSGGGGSGGGGSLEMAQLQLQESGGGSVQPGGSLRLSCAASGFTFSNYAMSWVRQAPGKGLEWVSAITNSGRSTYYADSVKGRFTISRDNSKNTLSLQMSSLRAEDTAVYYCARVTHRRYGSTFDSRGQGTLVTVSS

SEQ ID NO: 768 - protein, 250 aa, Artificial Sequence
  source: /note="Description of Artificial Sequence: Synthetic scFv sequence"
NFMLTQPHSVSESPGKTVSISCTRTSGAIAGAYVQWFQQRPGSAPTTVIYDDNKRPSGVPDRFSGSIDKSSNSASLTISGLKTEDEADYYCQSYDYDSSNVLFGGGTKLTVLGSRGGGGSGGGGSGGGGSLEMAEVQLVESGGGLVQPGGSLRLSCAASGFTFSNYAMSWVRQAPGKGLEWVSAISGSGNTYYADSVKGRFTISRDNSKNTLYLQMNSLRAEDTAVYYCARGSVRYTDIWGQGTLVTVSS

SEQ ID NO: 769 - protein, 253 aa, Artificial Sequence
  source: /note="Description of Artificial Sequence: Synthetic scFv sequence"
QAVLTQPPSASGTPGQRVTISCSGSSSNIGSNYVYWYQQLPGTAPKLLIYRNNQRPSGVPDRFSGSKSGTSASLAISGLRSEDEADYYCAAWDDSLSGYVFGTGTKVTVLGSRGGGGSGGGGSGGGGSLEMAQVQLVQSGAEVQRPGASVRVSCKAIAYTFTDYYIHWVRQAPGQGPEWMGWINPKSGRTQYAPKFQDRVTLARETPISTASMELRGLTSDDTAVYYCARVYGYSRWSGFDLWGQGTLVTVSS

SEQ ID NO: 770 - protein, 256 aa, Artificial Sequence
  source: /note="Description of Artificial Sequence: Synthetic scFv sequence"
QSALTQPASVSGSPGQSITISCTGTSRDVGGYNYVSWYQQYPGKAPKLMIYEVSKRPSGVSNRFSGSKSGNTASLTISGLQAEDEADYYCSSYTSSSTLDFGTGTKVTVLGSRGGGGSGGGGSGGGGSLEMAQVQLVQSGAEVKQPGASVKVSCQASGYTFTTYYMHWVRQAPGQGLEWMGIINPNGGGTFYAQKFQDRVTMTRDTSTGTVYMELSSLRSDDTAVYYCARGHKVYKSHPTGGYDRWGQGTLVTVSS

SEQ ID NO: 771 - protein, 253 aa, Artificial Sequence
  source: /note="Description of Artificial Sequence: Synthetic scFv sequence"
QSALTQPASVSGSPGQSITISCTGTSSDVGGYNFVSWYQQHPGKAPKVMIYDVSKRPSGISNRFSGSKSGNTASLTISGLQVEDEAEYYCSSYTSTRTVIFAGGTKVTVLGSRGGGGSGGGGSGGGGSLEMAQVQLVQSGAEVKKPGASVKVSCKASGYTFTSYYMHWVRQAPGQGLEWMGIINPSGGSTRYAQKFQGRVTMTRDTSTSTVYMELSSLRSEDTAVYYCARGSSRWGGWTGDYWGQGTLVTVSS

SEQ ID NO: 772 - protein, 259 aa, Artificial Sequence
  source: /note="Description of Artificial Sequence: Synthetic scFv sequence"
QSALTQPASVSGSPGQSITISCTGTSSDVGGYNYVSWYQQHPGKAPKLMIYDVSKRPSGVSNRFSGSKSGNTASLTISGLQAEDEADYYCSSYTRSSTEVFGGGTKLTVLGSRGGGGSGGGGSGGGGSLEMAEVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCARGGSKKWSGEKWRRENFDYWGQGTLVTVSS

SEQ ID NO: 773 - protein, 249 aa, Artificial Sequence
  source: /note="Description of Artificial Sequence: Synthetic scFv sequence"
QSALTQPASVSGSPGQSITISCTGTSSDVGGYNYVSWYQQSPGKAPRLMIYGVSKRPSGVPDRFSGSKSGNTASLTVSGLQAEDEADYYCSSYAGVNNLMFGGGTKLTVLGSRGGGGSGGGGSGGGGSLEMAQVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCARDVISGFDSWGQGTLVTVSS

SEQ ID NO: 774 - protein, 247 aa, Artificial Sequence
  source: /note="Description of Artificial Sequence: Synthetic scFv sequence"
QSALTQPPSASGSPGQSVTISCTGTSRDAGGYNYFSWYQQHPGKAPKLLIYEVTKRPSGVPDRFSGSKSGKTASLTVSGLQADDEAVYYCSSYGGSNNFRVFGGGTKLTVLGSRGGGGSGGGGSGGGGSLEMAEVQLVESGGGVVRPGGSLRLSCAASGFTFGDYGMSWVRQAPGKGLEWVSGINWNGGSTGYADSVKGRFTISRDNAKNSLYLQMNSLRAEDTAVYYCARSKQDYWGQGTLVTVSS

SEQ ID NO: 775 - protein, 249 aa, Artificial Sequence
  source: /note="Description of Artificial Sequence: Synthetic scFv sequence"
QSALTQPPSASGSPGQSVTISCTGTSSDIGGYNYVSWYQQHPGKAPKLMIYEVNKRPSGVPDRFSGSKSGNTASLTVSGLQAEDEADYYCASFAGRKTLVFGGGTKLTVLGSRGGGGSGGGGSGGGGSLEMAQVQLVQSGAEVKKPGASVKVSCRASGYTFTAYSLHWVRQAPGQGLEWMGWINPSSGGAVYAQKFQGRVTMTRDTSISTAYMELSGLRSDDTAVYYCARNVGGQADDWGQGTLVTVSS

SEQ ID NO: 776 - protein, 248 aa, Artificial Sequence
  source: /note="Description of Artificial Sequence: Synthetic scFv sequence"
QSALTQPPSASGSPGQSVTISCTGTSSDVGGYNYVSWYQQHPGKAPKLMIYEVSKRPSGVPDRFSGSKSGNTASLTVSGLQAEDEADYYCSSYAGSNTLVFGGGTKLTVLGSRGGGGSGGGGSGGGGSLEMAQMQLVQSGAEVKKPGASVKVSCKASGYTFTSYYMHWVRQAPGQGLEWMGIINPSGGSSSYAQKFQGRVTMTRDTSTSTVYMELSSLRSEDTAVYYCARAGMGMDTWGQGTLVTVSS

SEQ ID NO: 777 - protein, 248 aa, Artificial Sequence
  source: /note="Description of Artificial Sequence: Synthetic scFv sequence"
QSALTQPPSASGSPGQSVTISCTGTSSDVGGYNYVSWYQQHPGKAPKLMIYEVSKRPSGVPDRFSGSKSGNTASLTVSGLQAEDEADYYCSSYAGSNTLVFGGGTKLTVLGSRGGGGSGGGGSGGGGSLEMAQMQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCARAGMGMDTWGQGTLVTVSS

SEQ ID NO: 778 - protein, 249 aa, Artificial Sequence
  source: /note="Description of Artificial Sequence: Synthetic scFv sequence"
QSALTQPPSASGSPGQSVTISCTGTSTDIGGYNYVSWYQHHPSKAPKLMIYEVNKRPSGVPDRFSGSKSGNTASLTVSGLQAEDEADYYCASFAGRKTLVFGGGTKLTVLGSRGGGGSGGGGSGGGGSLEMAQVQLVQSGAEVKKPGASVKVSCRASGYTFTAYSLHWVRQAPGQGLEWMGWINPSSGGAVYAQKFQGRVTMTRDTSISTAYMELSGLRSDDTAVYYCARNVGGHADDWGQGTLVTVSS

SEQ ID NO: 779 - protein, 246 aa, Artificial Sequence
  source: /note="Description of Artificial Sequence: Synthetic scFv sequence"
QSVLTQPASVSGSPGQSLTISCTGTSNDVGAYKYVSWYQQYPGKAPKLILYDVFKRPSGVSNRFSGSKSDNTASLTISGLQAEDEADYYCFSLTSSNTYVFGTGTKVTVLGSRGGGGSGGGGSGGGGSLEMAQMQLVQSGAEVKKPGASVKVSCKASGYTFNRYAITWVRQAPGQGLEWMGWISAYNGNSHYAQKLQGRVTMTTDTSTGTAYMELRRLRSDDTAVYYCARMAYDSWGQGTLVTVSS

SEQ ID NO: 780 - protein, 249 aa, Artificial Sequence
  source: /note="Description of Artificial Sequence: Synthetic scFv sequence"
QSVLTQPPSASGTPGQRVTISCSGSRSNVGGNYVFWYQQVPGATPKLLIYRSNQRPSGVPDRFAGSKSGSSASLAISGLRSEDEADYYCATWDDSLSGFVFGTGTKVTVLGSRGGGGSGGGGSGGGGSLEMAEVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARGYGKAYDQWGQGTLVTVSS

SEQ ID NO: 781 - protein, 252 aa, Artificial Sequence
  source: /note="Description of Artificial Sequence: Synthetic scFv sequence"
QSVLTQPPSASGTPGQRVTISCSGSSSNIGSNYVYWYQQLPGTAPKLLIYRNNQRPSGVPDRFSGSKSGTSASLAISGLRSEDEADYYCAAWDDSLSGWVFGGGTKLTVLGSRGGGGSGGGGSGGGGSLEMAQVQLVQSGAEVKKPGSSVKVSCKASGGTFSSYAISWVRQAPGQGLEWMGWMNPNSGNTGYAQKFQGRVTMTRNTSISTAYMELSSLRSEDTAVYYCARYQSYKGSQSDSWGQGTLVTVSS

SEQ ID NO: 782 - protein, 249 aa, Artificial Sequence
  source: /note="Description of Artificial Sequence: Synthetic scFv sequence"
  MOD_RES (37)..(37): Any amino acid
QSVLTQPPSLSGAPGQRVTISCSGSRSNIGTNYVSWXQQLPGTAPKLLIYRNHQWPSGVPDRFTGSKSGTSASLAISGLRSEDEADYYCAAWDDNLSGVVFGGGTKLTVLGSRGGGGSGGGGSGGGGSLEMAEVQLVETGGGLVQPGGSLRLSCAASGSTFSSYAMSWVRQAPGKGLEWVSAISGRGRSTYYADSVKGRFTISRDNSKNTLYLQMNSLRAEDTAVYYCARYYKSSKDHWGQGTLVTVSS

SEQ ID NO: 783 - protein, 252 aa, Artificial Sequence
  source: /note="Description of Artificial Sequence: Synthetic scFv sequence"
QSVLTQPPSVSAAPGQKVTIPCSGSRSNVGNYYVSWYQQLPGTAPKLLIYDNNKRPSGIPDRFSGSKSGTSATLGITGLQTGDEADYFCGTWDGSLSAHVFGTGTKVTVLGSRGGGGSGGGGSGGGGSLEMAQVQLVQSGSELKKPGASVRVSCTASGYTFTSYYMHWVRQAPGQGLEWMGVINPNAGSTRYAQKFQGRVTMSTDTSTSTAYMDLSSLRSEDTAVYYCARGMYRSLLFYDPWGQGTLVTVSS

SEQ ID NO: 784 - protein, 250 aa, Artificial Sequence
  source: /note="Description of Artificial Sequence: Synthetic scFv sequence"
QSVVTQPASVSGSPGQSITISCTGTSSDVGGYNYVSWYQQHPGKAPKLMIYDVSKRPSGVSNRFSGSKSGNTASLTISGLQAEDEADYYCSSYTSSSTLVFGGGTKLTVLGSRGGGGSGGGGSGGGGSLEMAEVQLVESGGAFVQPGGSLRLSCAASGFTFSSYAMTWVRQAPGKGLEWVSTISGRGRSTFYADSVKGRFTISRDNSKNTLYLQMNSLRAEDTAVYYCARYYHAGAFDLWGQGTLVTVSS

SEQ ID NO: 785 - protein, 248 aa, Artificial Sequence
  source: /note="Description of Artificial Sequence: Synthetic scFv sequence"
QSVVTQPPSMSAAPGQQVTISCSGGNSNIERNYVSWYLQLPGTAPKLVIFDNDRRPSGIPDRFSGSKSGTSATLGITGLQTGDEADYYCGTWDSSLRGWVFGGGTKLTVLGSRGGGGSGGGGSGGGGSLEMAEVQLVESGGGLIQPGGSLRLSCAASGFTFSNYAMNWVRQAPGKGLEWVSTINGRGSSTIYADSVKGRFTISRDNSKNTLYLQMNSLRAEDTATYYCARYISRGLGDSWGQGTLVTV

SEQ ID NO: 786 - protein, 261 aa, Artificial Sequence
  source: /note="Description of Artificial Sequence: Synthetic scFv sequence"
QSVVTQPPSVSAAPGQKVTISCSGSSSNIGNNYVSWYQQLPGTAPKLLIYDNNKRPSGIPDRFSGSKSGTSATLGITGLQTGDEADYYCGTWDSSLSGVVFGGGTKLTVLGSRGGGGSGGGGSGGGGSLEMAQVQLVQSGGEVKKPGASVKVSCKASGFTFNTYGISWVRQAPGQGLEWMGWISANNGHTKSAQRFQDRVAMATDTSTSTAYMELRSLKFDDTAVYYCARGGYHHQMQRYYKATSVYSDYWGQGTLVTVSS

SEQ ID NO: 787 - protein, 248 aa, Artificial Sequence
  source: /note="Description of Artificial Sequence: Synthetic scFv sequence"
QSVVTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGSYVFGTGTKLTVLGSRGGGGSGGGGSGGGGSLEMAEVQLVETGGNLVQPGASLRLSCAASGFSFSGTAMHWVRQAPGKGLEWVSTISSTGRSTYYRDSVKGRFTISRDNSKNTLYLQMNSLRGEDTAVYYCARVSFDYWGQGTLVTVSS

SEQ ID NO: 788 - protein, 250 aa, Artificial Sequence
  source: /note="Description of Artificial Sequence: Synthetic scFv sequence"
SSELTQDPAVSVALGQTVRITCQGDSLRSYYASWYQQKPGQAPVLVIYGKNNRPSGIPDRFSGSSSGNTASLTITGAQAEDEADYYCNSRDSSGNPPVVFGGGTKLTVLGSRGGGGSGGGGSGGGGSLEMAQVQLVESGGGLVHPGGSLRLSCAASGFTFRSHSMNWVRQAPGKGLEWVSSISSDSTYTYYADSVKGRFTISRDNAKNSLYLQMNSLRAEDTAVYYCARSGGQWKYYDYWGQGTLVTVSS

SEQ ID NO: 789 - protein, 251 aa, Artificial Sequence
  source: /note="Description of Artificial Sequence: Synthetic scFv sequence"
SYELTQPPSASGTPGQRVTISCSGSSSNIGSNYVSWYQQLPGTAPKLLIYRNNQRPSGVPDRFSGSKSGTSASLAISGLRSEDEADYYCAAWDDSLSGVVFGGGTKLTVLGSRGGGGSGGGGSGGGGSLEMAEVQLVQSGAEVKKPGSSVKVSCKASGGTFSSYAISWVRQAPGQGLEWMGGIIPIFGTAKYAQKFQGRVTITADESTSTAYMELSSLRSEDTAVYYCARSHVAWSLLDYWGQGTLVTVSS

SEQ ID NO: 790 - protein, 244 aa, Artificial Sequence
  source: /note="Description of Artificial Sequence: Synthetic scFv sequence"
SYVLTQPPSASGTPGQRVTISCSGSSSNIGSNTVNWYQQLPGTAPKLLIYRNNQRPSGVPDRFSGSKSGTSASLAISGLRSEDEADYYCAAWDDSLSGLFGTGTKVTVLGSRGGGGSGGGGSGGGGSLEMAQMQLVQSGAEVKKPGASVKVSCKASEYTFTRHILHWVRQAPGQSLEWMGWINPGNGNTKYSQKFQVRVTFTRDTSASTVYMELSSLRSEDTAVYYCARLPDQWGQGTLVTVSS

SEQ ID NO: 791 - protein, 263 aa, Artificial Sequence
  source: /note="Description of Artificial Sequence: Synthetic scFv sequence"
MAVLGLLFCLVTFPSCVLSQVQVKESGPFLVPPSQSLSITCTVSGFSLTTYGVSWIRQPPGKGLEWLGAIWGDGTTNYHSALISRLSISKDNSKSQVFLKLNSLQTDDTATYYCAKLGNYDALDYWGQGTSVTVSSGGGGSGGGGSGGGGSDVLMTQTPLSLPVSLGDQASISCRSSQSIVHSNGNTYLEWYLQKPGQSPNLLIYFVSNRFSGVPDRFSGSGSGTDFTLKISRVEAEDLGVYYCFQGSHVPWTFGGGTKLEIK

SEQ ID NO: 792 - protein, 291 aa, Artificial Sequence
  source: /note="Description of Artificial Sequence: Synthetic scFv sequence"
MKYLLPTAAAGLLLLAAQPAMAQVQLVESGGGLVQPGGSLRLSCAASGFTFRSYAMSWVRQAPGKGLEWVSAISGRGDNTYYADSVKGRFTISRDNSKNTLYLQMNSLRAEDTAVYYCAKMTSNAFAFDYWGQGTLVTVSSGGGGSGGGGSGGGGSQSVLTQPPSVSGAPGQRVTISCTGSSSNIGAGYGVHWYQQLPGTAPKLLIYGNTNRPSGVPDRFSGFKSGTSASLAITGLQAEDEADYYCQSYDSSLSGWVFGGGTKLTVLGAAAEQKLISEEDLNGAAHHHHHH

SEQ ID NO: 793 - protein, 291 aa, Artificial Sequence
  source: /note="Description of Artificial Sequence: Synthetic scFv sequence"
MKYLLPTAAAGLLLLAAQPAMAQVQLVQSGGGLVQPGRSLRLSCAASGFTFDDYAMHWVRQAPGKGLEWVSGISWNSGSIGYADSVKGRFTISRDNAKNSLYLQMNSLRPEDTAVYYCARDLGAKQWLEGFDYWGQGTLVTVSSGGGGSGGGGSGGGGSNFMLTQDPAVSVALGQTVRITCQGDSLRSYYASWYQQKPGQAPVLVIYGKNNRPSGIPDRFSGSTSGNSASLTITGAQAEDEADYYCNSRDSSGNHWVFGGGTKVTVLGAAAEQKLISEEDLNGAAHHHHHH

SEQ ID NO: 794 - protein, 278 aa, Artificial Sequence
  source: /note="Description of Artificial Sequence: Synthetic scFv sequence"
MRFSTTLATAATALFFTASQVSAEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSGGGGSGGGGSGGGGSGGGGSDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKSGHHHHHH

SEQ ID NO: 795 - protein, 280 aa, Artificial Sequence
  source: /note="Description of Artificial Sequence: Synthetic scFv sequence"
MRFSTTLATAATALFFTASQVSAGHHHHHHSGEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSGGGGSGGGGSGGGGSGGGGSDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKS

SEQ ID NO: 796 - protein, 665 aa, Artificial Sequence
  source: /note="Description of Artificial Sequence: Synthetic scFv sequence"
MTVLAPAWSPTTYLLLLLLLSSGLSGTQDCSFQHSPISSDFAVKIRELSDYLLQDYPVTVASNLQDEELCGGLWRLVLAQRWMERLKTVAGSKMQGLLERVNTEIHFVTKCAFQPPPSCLRFVQTNISRLLQETSEQLVALKPWITRQNFSRCLELQCQPDSSTLPPPWSPRPLEATAPTAPEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSASTKGPSVGGGGSGGGGSGGGGSDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKR

SEQ ID NO: 797 - protein, 643 aa, Artificial Sequence
  source: /note="Description of Artificial Sequence: Synthetic scFv sequence"
EVQLLEQSGAELVRPGALVKLSCKASGFKIKDYFVNWVKQRPEQGLEWIGWIDPENDNSLYGPNFQDKASITADTSSNTGYLQLSGLTSEDTAVYYCALYYGSRGDAMDYWGQGTTVTVSSGGGGSGGGGSGGGGSELVMTQTPSSLSASLGDRVTISCRASQDISNYLNWYQQKPDGTVKLLIYYTSRLHSGVPSRFSGSGSGTDYSLTISNLEQEDIATYFCQQGNTLPLTFGAGTKLEIKSGGGGSEVQLVESGGGLVQPGGSLKLSCAASGFTFNSYAMNWVRQAPGKGLEWVARIRSKYNNYATYYADSVKGRFTISRDDSKNTAYLQMNNLKTEDTAVYYCVRHGNFGNSYVSWWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLAAADYKDDDDKGSSHHHHHHEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSS

SEQ ID NO: 798 - protein, 260 aa, Artificial Sequence
  source: /note="Description of Artificial Sequence: Synthetic scFv sequence"
DVQITQSPSYLAASPGETITINCRASKSISKYLAWYQEKPGKTNKLLIYSGSTLQSGIPSRFSGSGSGTDFTLTISSLEPEDFAMYYCQQHNEYPYTFGGGTKLEIKRGSTSGSGKPGSGEGSTKGEVMLVESGGGLVKPGGSLKLSCAASGFTFSSYAMSWVRQTPEKRLEWVATITSGGDYTFYPDSVKGRFTISRDNAKNTLYLQMSSRRSEDTAMYYCARHGEIGYGSSAWFAYWGQGTLVTVSAGGGGSGGGGSC

SEQ ID NO: 799 - protein, 232 aa, Artificial Sequence
  source: /note="Description of Artificial Sequence: Synthetic scFv sequence"
QVQLVQSGAEVKEPGSSVKVSCKASGGTFSSYAIYWVRQAPGQGLEWMGWINPDSGDTNSAQQFQGRVTMTRDTSISTAYMELSRLRSDDTAMYYCARPPRGDGPDYWGQGTLVTVSSGGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPRTFGQGTKVDIK

SEQ ID NO: 800 - protein, 244 aa, Artificial Sequence
  source: /note="Description of Artificial Sequence: Synthetic scFv sequence"
QVQLVQSGAEVKKPGASVKVSCKASGYTFSNYGITWVRQAPGQGLEWMGWINNGNTHYAQKFQGRVTMTTDTSTSTAYMELRSLRSDDTAVYYCARDPRGDDEPYWGQGTLVTVSSGGGGSGGGGSGGGGSEIVLTQSPLSLPVTLGQPASISCRSSQNLVYSDGNTYLSWFQQRPGQSPRRLIYKVSNRDSGVPDRFSGSGSGTDFTLKISRVEAEDIGVYYCMQGTHWPPRTFGQGTKVEIK

SEQ ID NO: 801 - protein, 255 aa, Artificial Sequence
  source: /note="Description of Artificial Sequence: Synthetic scFv sequence"
EIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIKGSTSGSGKPGSGEGSTKGQVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGGGGSGGGGSC

SEQ ID NO: 802 - protein, 511 aa, Artificial Sequence
  source: /note="Description of Artificial Sequence: Synthetic scFv sequence"
METDTLLLWVLLLWVPAGNGEVQLVESGGGLVQPGGSLRLSCSFSGFSLSTSGMGVSWVRQAPGKGLEWLAHIYWDDDKRYNPSLKSRFTISRDNSKNTVYLQMNSLRAEDTAVYYCARRETVFYWYFDVWGQGTTVTVSSGGGGSGGGGSGGGTGDIVMTQSPDSLAVSLGDRATINCKASQSVDYDGDSYMNWYQQKPGQPPKLLIYAASNLESGVPDRFSGSGSGTDFTLTISSLQAEDVAVYYCQQSNEDPPTFGGGTKVEISSSSGSDKTHTCPPCPAPELLGGPSVFLFPPKPKDTLMISRTPEVTCWVDVSHEDPEVKFNWYVDGVEVHNAKTKPREEQYNSTYRWSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGSSSSSSAWSHPQFEK

SEQ ID NO: 803 - protein, 506 aa, Artificial Sequence
  source: /note="Description of Artificial Sequence: Synthetic scFv sequence"
METDTLLLWVLLLWVPAGNGEVQLVESGGGLVKPGGSLRLSCAASGFTFNTNAMNWVRQAPGKGLEWVARIRSKSNNYATYYADSVKDRFTLSRDDSKNTLYLQMNSLKTEDTAVYYCTRDRGWGAMDYWGQGTTVTVSSGGGGSGGGGSGGGTGDIQMTQSPSSLSASVGDRVTITCSASQDINNYLNWYQQKPGKAPKLLIYYTSSLHSGVPSRFSGSGSGTDFTLTLSSLQPEDFATYYCQQFSNLPWTFGGGTKLEISSSSGSDKTHTCPPCPAPELLGGPSVFLFPPKPKDTLMISRTPEVTCWVDVSHEDPEVKFNWYVDGVEVHNAKTKPREEQYNSTYRWSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGSSSSSSAWSHPQFEK

SEQ ID NO: 804 - protein, 244 aa, Artificial Sequence
  source: /note="Description of Artificial Sequence: Synthetic scFv sequence"
QVQLQQSGAEVKKPGASVKVSCKASGYTFTGYYMHWVRQAPGQGLEWMGRINPNSGGTNYAQKFQGRVTMTRDTSISTAYMELSRLRSEDTAVYYCARGRYYGMDVWGQGTMVTVSSGGGGSGGGGSGGGGSGGGGSEIVLTQSPATLSLSPGERATISCRASQSVSSNFAWYQQRPGQAPRLLIYDASNRATGIPPRFSGSGSGTDFTLTISSLEPEDFAAYYCHQRSNWLYTFGQGTKVDIK

SEQ ID NO: 805 - protein, 252 aa, Artificial Sequence
  source: /note="Description of Artificial Sequence: Synthetic scFv sequence"
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCARYRLIAVAGDYYYYGMDVWGQGTMVTVSSGGGGSGGGGSGGGGSGGGGSDIQMTQSPSSVASVGDRVTITCRASQGVGRWLAWYQQKPGTAPKLLIYAASTLQSGVPSRFSGSGSGTDFTLTINNLQPEDFATYYCQQANSFPLTFGGGTRLEIK

SEQ ID NO: 806 - protein, 508 aa, Artificial Sequence
  source: /note="Description of Artificial Sequence: Synthetic scFv sequence"
VLTQTPSPVSAAVGGTVTINCQSSPSLIYDSRLAWYQQKPGQPPKLLIYKASTLASGVPSRFSGSGSGTQFTLTISDVQSDDAATYYCQSHDTNPGSSTYGAPFGGGTEVVVQGGGGSGGGGSSGGGSEVQLMESGGGLVKPEGSLTLTCKVSGFSFSTSAISWVRQAPGKRPEWIAGIYNGGGSTYYASWVNGRFSISRSTSLNTVTLQMTRLTAADTATYFCARWIRIHYSFDLWGPGTLVTVSSSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLHHHHHH

SEQ ID NO: 807 - protein, 245 aa, Artificial Sequence
  source: /note="Description of Artificial Sequence: Synthetic scFv sequence"
EVQLVESGGGLVQPGRSLRLSCAASGFTFDDYAMHWVRQAPGKGLEWVSISWNSGSTGYADSVKGRFTISRDNAKNSLYLQMNSLRAEDTALYYCAKDSSSWYGGGSAFDIWGQGTMVTVSSGGGGSGGGGSGGGGSSSELTQDPAVSVALGQTVRITCQGDSLRSYYASWYQQKPGQAPVLVIYGKNNRPSGIPDRFSGSSSGNTASLTITGAQAEDEADYYCNSRGSSGNHYVFGTGTKVTVL

SEQ ID NO: 808 - protein, 245 aa, Artificial Sequence
  source: /note="Description of Artificial Sequence: Synthetic scFv sequence"
EVQLVESGGGLVQPGRSLRLSCAASGFTFDDYAMHWVRQAPGKGLEWVSISWNSGSTGYADSVKGRFTISRDNAKNSLYLQMNSLRAEDTALYYCAKDSSSWYGGGSAFDIWGQGTMVTVSSGGGGSGGGGSGGGGSSSELTQEPAVSVALGQTVRITCQGDSLRSYYASWYQQKPGQAPVLVIFGRSRRPSGIPDRFSGSSSGNTASLIITGAQAEDEADYYCNSRDNTANHYVFGTGTKLTVL

SEQ ID NO: 809 - protein, 268 aa, Artificial Sequence
  source: /note="Description of Artificial Sequence: Synthetic scFv sequence"
MVLLVTSLLLCELPHPAFLLIPDIQAQVQLVQSGAEVKRPGASVQVSCRASGYSINTYYMQWVRQAPGAGLEWMGVINPSGVTSYAQKFQGRVTLTNDTSTNTVYMQLNSLTSADTAVYYCARWALWGDFGMDVWGKGTLVTVSSGGGGSGGGGSGGGGSDIQMTQSPSTLSASIGDRVTITCRASEGIYHWLAWYQQKPGKAPKLLIYKASSLASGAPSRFSGSGSGTDFTLTISSLQPDDFATYYCQQYSNYPLTFGGGTKLEIKR

SEQ ID NO: 810 - protein, 267 aa, Artificial Sequence
  source: /note="Description of Artificial Sequence: Synthetic scFv sequence"
MVLLVTSLLLCELPHPAFLLIPDIQQVQLQQSGPELEKPGASVKISCKASGYSFTGYTMNWVKQSHGKSLEWIGLITPYNGASSYNQKFRGKATLTVDKSSSTAYMDLLSLTSEDSAVYFCARGGYDGRGFDYWGQGTTVTVSSGGGGSGGGGSGGGGSDIELTQSPAIMSASPGEKVTMTCSASSSVSYMHWYQQKSGTSPKRWIYDTSKLASGVPGRFSGSGSGNSYSLTISSVEAEDDATYYCQQWSGYPLTFGAGTKLEIKAA

SEQ ID NO: 811 - protein, 265 aa, Artificial Sequence
  source: /note="Description of Artificial Sequence: Synthetic scFv sequence"
MVLLVTSLLLCELPHPAFLLIPDIQQVQLQQSGPELEKPGASVKISCKASGYSFTGYTMNWVKQSHGKSLEWIGLITPYNGASSYNQKFRGKATLTVDKSSSTAYMDLLSLTSEDSAVYFCARGGYDGRGFDYWGQGTTVTVSSGGGGSGGGGSSGGGSDIELTQSPAIMSASPGEKVTMTCSASSSVSYMHWYQQKSGTSPKRWIYDTSKLASGVPGRFSGSGSGNSYSLTISSVEAEDDATYYCQQWSKHPLTFGAGTKLEIK

SEQ ID NO: 812 - protein, 262 aa, Artificial Sequence
  source: /note="Description of Artificial Sequence: Synthetic scFv sequence"
QVQLQESGPGLVKPSETLSLTCTVSGGSVSSGSYYWSWIRQPPGKGLEWIGYIYYSGSTNYNPSHKSRVTISVDTSKNQFSLKLSSVTAADTAVYYCAREGKNGAFDIWGQGTMVTVSSSGGGGSGGGGSGGGGERHQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIKGQAGHHHHHHGDYKDDDDKG

SEQ ID NO: 813 - protein, 243 aa, Artificial Sequence
  source: /note="Description of Artificial Sequence: Synthetic scFv sequence"
QVQLQQSGAEVKKPGASVKVSCKASGYTFTGYYMHWVRQAPGQGLEWMGINPNSGGTNYAQKFQGRVTMTRDTSISTAYMELSRLRSEDTAVYYCARGRYYGMDVWGQGTMVTVSSGGGGSGGGGSGGGGSGGGGSEIVLTQSPATLSLSPGERATISCRASQSVSSNFAWYQQRPGQAPRLLIYDASNRATGIPPRFSGSGSGTDFTLTISSLEPEDFAAYYCHQRSNWLYTFGQGTKVDIK

SEQ ID NO: 814 - protein, 240 aa, Artificial Sequence
  source: /note="Description of Artificial Sequence: Synthetic scFv sequence"
QVQLQQSGAEVKKPGASVKVSCKASGYTFTGYYMHWVRQAPGQGLEWMGINPNSGGTNYAQNFQGRVTMTRDTSISTAYMELRRLRSDDTAVYYCASGWDFDYWGQGTLVTVSSGGGGSGGGGSGGGGSGGGGSDIRMTQSPSSLSASVGDRVTITCRASQSIRYYLSWYQQKPGKAPKLLIYTASILQNGVPSRFSGSGSGTDFTLTISSLQPEDFATYYCLQTYTTPDFGPGTKVEIK

SEQ ID NO: 815 - protein, 249 aa, Artificial Sequence
  source: /note="Description of Artificial Sequence: Synthetic scFv sequence"
QVQLQQSGAEVKKPGASVKVSCKASGYTFTNYYMHWVRQAPGQGLEWMGLINPSGGYTTYAQKFQGRLTMTRDTSTSTVYMELSSLRSEDTAVYYCARIRSCGGDCYYFDNWGQGTLVTVSSGGGGSGGGGSGGGGSGGGGSDIQLTQSPSTLSASVGDRVTITCRASENVNIWLAWYQQKPGKAPKLLIYKSSSLASGVPSRFSGSGSGAEFTLTISSLQPDDFATYYCQQYQSYPLTFGGGTKVDIK

SEQ ID NO: 816 - protein, 245 aa, Artificial Sequence
  source: /note="Description of Artificial Sequence: Synthetic scFv sequence"
QVQLQQSGAEVKKPGASVKVSCKTSGYPFTGYSLHWVRQAPGQGLEWMGINPNSGGTNYAQKFQGRVTMTRDTSISTAYMELSRLRSDDTAVYYCARDHYGGNSLFYWGQGTLVTVSSGGGGSGGGGSGGGGSGGGGSDIQLTQSPSSISASVGDTVSITCRASQDSGTWLAWYQQKPGKAPNLLMYDASTLEDGVPSRFSGSASGTEFTLTVNRLQPEDSATYYCQQYNSYPLTFGGGTKVDIK

SEQ ID NO: 817 - protein, 239 aa, Artificial Sequence
  source: /note="Description of Artificial Sequence: Synthetic scFv sequence"
QVQLQQSGPELEKPGASVKISCKASGYSFTGYTMNWVKQSHGKSLEWIGLITPYNGASSYNQKFRGKATLTVDKSSSTAYMDLLSLTSEDSAVYFCARGGYDGRGFDYWGQGTTVTVSSGGGGSGGGGSGGGGSDIELTQSPAIMSASPGEKVTMTCSASSSVSYMHWYQQKSGTSPKRWIYDTSKLASGVPGRFSGSGSGNSYSLTISSVEAEDDATYYCQQWSGYPLTFGAGTKLEI

SEQ ID NO: 818 - protein, 259 aa, Artificial Sequence
  source: /note="Description of Artificial Sequence: Synthetic scFv sequence"
QVQLQQSGPGLVTPSQTLSLTCAISGDSVSSNSATWNWIRQSPSRGLEWLGRTYYRSKWYNDYAVSVKSRMSINPDTSKNQFSLQLNSVTPEDTAVYYCARGMMTYYYGMDVWGQGTTVTVSSGILGSGGGGSGGGGSGGGGSQPVLTQSSSLSASPGASASLTCTLRSGINVGPYRIYWYQQKPGSPPQYLLNYKSDSDKQQGSGVPSRFSGSKDASANAGVLLISGLRSEDEADYYCMIWHSSAAVFGGGTQLTVLS

SEQ ID NO: 819 - protein, 241 aa, Artificial Sequence
  source: /note="Description of Artificial Sequence: Synthetic scFv sequence"
QVQLVESGGGLVQPGGSLRLSCAASGFTFSSYWMHWVRQVPGKGLVWVSINTDGSTTTYADSVEGRFTISRDNAKNTLYLQMNSLRDDDTAVYYCVGGHWAVWGQGTTVTVSSGGGGSGGGGSGGGGSGGGGSDIQMTQSPSTLSASVGDRVTITCRASQSISDRLAWYQQKPGKAPKLLIYKASSLESGVPSRFSGSGSGTEFTLTISSLQPDDFAVYYCQQYGHLPMYTFGQGTKVEIK

SEQ ID NO: 820 - protein, 240 aa, Artificial Sequence
  source: /note="Description of Artificial Sequence: Synthetic scFv sequence"
QVQLVQSGAEVEKPGASVKVSCKASGYTFTDYYMHWVRQAPGQGLEWMGINPNSGGTNYAQKFQGRVTMTRDTSISTAYMELSRLRSDDTAVYYCASGWDFDYWGQGTLVTVSSGGGGSGGGGSGGGGSGGGGSDIVMTQSPSSLSASVGDRVTITCRASQSIRYYLSWYQQKPGKAPKLLIYTASILQNGVPSRFSGSGSGTDFTLTISSLQPEDFATYYCLQTYTTPDFGPGTKVEIK

SEQ ID NO: 821 - protein, 245 aa, Artificial Sequence
  source: /note="Description of Artificial Sequence: Synthetic scFv sequence"
QVQLVQSGAEVKKPGAPVKVSCKASGYTFTGYYMHWVRQAPGQGLEWMGINPNSGGTNYAQKFQGRVTMTRDTSISTAYMELSRLRSDDTAVYYCARGEWDGSYYYDYWGQGTLVTVSSGGGGSGGGGSGGGGSGGGGSDIVLTQTPSSLSASVGDRVTITCRASQSINTYLNWYQHKPGKAPKLLIYAASSLQSGVPSRFSGSGSGTDFTLTISSLQPEDFATYYCQQSFSPLTFGGGTKLEIK

SEQ ID NO: 822 - protein, 248 aa, Artificial Sequence
  source: /note="Description of Artificial Sequence: Synthetic scFv sequence"
QVQLVQSGAEVKKPGASVEVSCKASGYTFTSYYMHWVRQAPGQGLEWMGLINPSGGSTGYAQKFQGRVTMTRDTSTSTVHMELSSLRSEDTAVYYCARGGYSSSSDAFDIWGQGTMVTVSSGGGGSGGGGSGGGGSGGGGSDIQMTQSPPSLSASVGDRVTITCRASQDISSALAWYQQKPGTPPKLLIYDASSLESGVPSRFSGSGSGTDFTLTISSLQPEDFATYYCQQFSSYPLTFGGGTRLEIK

SEQ ID NO: 823 - protein, 252 aa, Artificial Sequence
  source: /note="Description of Artificial Sequence: Synthetic scFv sequence"
QVQLVQSGAEVKKPGASVKVSCKASGYTFTGYYMHWVRQAPGQGLEWMGINPNSGGTNYAQKFQGRVTMTRDTSISTAYMELSRLRSDDTAVYYCARDLRRTVVTPRAYYGMDVWGQGTTVTVSSGGGGSGGGGSGGGGSGGGGSDIQLTQSPSTLSASVGDRVTITCQASQDISNSLNWYQQKAGKAPKLLIYDASTLETGVPSRFSGSGSGTDFSFTISSLQPEDIATYYCQQHDNLPLTFGQGTKVEIK

SEQ ID NO: 824 - protein, 245 aa, Artificial Sequence
  source: /note="Description of Artificial Sequence: Synthetic scFv sequence"
QVQLVQSGAEVKKPGASVKVSCKASGYTFTGYYMHWVRQAPGQGLEWMGINPNSGGTNYAQKFQGRVTMTTDTSTSTAYMELRSLRSDDTAVYYCARTTTSYAFDIWGQGTMVTVSSGGGGSGGGGSGGGGSGGGGSDIQLTQSPSTLSASVGDRVTITCRASQSISTWLAWYQQKPGKAPNLLIYKASTLESGVPSRFSGSGSGTEFTLTISSLQPDDFATYYCQQYNTYSPYTFGQGTKLEIK

SEQ ID NO: 825 - protein, 254 aa, Artificial Sequence
  source: /note="Description of Artificial Sequence: Synthetic scFv sequence"
QVQLVQSGAEVKKPGASVKVSCKASGYTFTSYGISWVRQAPGQGLEWMGISAYNGNTNYAQKLQGRVTMTTDTSTSTAYMELRSLRSDDTAVYYCARVAGGIYYYYGMDVWGQGTTITVSSGGGGSGGGGSGGGGSGGGGSDIVMTQTPDSLAVSLGERATISCKSSHSVLYNRNNKNYLAWYQQKPGQPPKLLFYWASTRKSGVPDRFSGSGSGTDFTLTISSLQPEDFATYFCQQTQTFPLTFGQGTRLEIN

SEQ ID NO: 826 - protein, 251 aa, Artificial Sequence
  source: /note="Description of Artificial Sequence: Synthetic scFv sequence"
QVQLVQSGAEVKKPGASVKVSCKASGYTFTSYYMHWVRQAPGQGLEWMGLINPSGGSTSYAQKFQGRVTMTRDTSTSTVYMELSSLRSEDTAVYYCARYRLIAVAGDYYYYGMDVWGQGTMVTVSSGGGGSGGGGSGGGGSGGGGSDIQMTQSPSSVASVGDRVTITCRASQGVGRWLAWYQQKPGTAPKLLIYAASTLQGVPSRFSGSGSGTDFTLTINNLQPEDFATYYCQQANSFPLTFGGGTRLEIK

SEQ ID NO: 827 - protein, 249 aa, Artificial Sequence
  source: /note="Description of Artificial Sequence: Synthetic scFv sequence"
QVQLVQSGAEVRAPGASVKISCKASGFTFRGYYIHWVRQAPGQGLEWMGLINPSGGSRAYAQKFQGRVTMTRDTSTSTVYMELSSLRSDDTAMYYCARTASCGGDCYYLDYWGQGTLVTVSSGGGGSGGGGSGGGGSGGGGSDIQMTQSPPTLSASVGDRVTITCRASENVNIWLAWYQQKPGKAPKLLIYKSSSLASGVPSRFSGSGSGAEFTLTISSLQPDDFATYYCQQYQSYPLTFGGGTKVDIK

SEQ ID NO: 828 - protein, 252 aa, Artificial Sequence
  source: /note="Description of Artificial Sequence: Synthetic scFv sequence"
QVQLVQSGAEVRRPGASVKISCRASGDTSTRHYIHWLRQAPGQGPEWMGINPTTGPATGSPAYAQMLQGRVTMTRDTSTRTVYMELRSLRFEDTAVYYCARSVVGRSAPYYFDYWGQGTLVTVSSGGGGSGGGGSGGGGSGGGGSDIQMTQSPSSLSASVGDRVTITCRASQGISDYSAWYQQKPGKAPKLLIYAASTLQSGVPSRFSGSGSGTDFTLTISYLQSEDFATYYCQQYYSYPLTFGGGTKVDIK

SEQ ID NO: 829 - protein, 249 aa, Artificial Sequence
  source: /note="Description of Artificial Sequence: Synthetic scFv sequence"
QVQLVQSGGGLVKPGGSLRLSCEASGFIFSDYYMGWIRQAPGKGLEWVSIIGRSGSSMYYADSVKGRFTFSRDNAKNSLYLQMNSLRAEDTAVYYCAASPVVAATEDFQHWGQGTLVTVSSGGGGSGGGGSGGGGSGGGGSDIVMTQTPATLSLSPGERATLSCRASQSVTSNYLAWYQQKPGQAPRLLLFGASTRATGIPDRFSGSGSGTDFTLTINRLEPEDFAMYYCQQYGSAPVTFGQGTKLEIK

SEQ ID NO: 830 - protein, 248 aa, Artificial Sequence
  source: /note="Description of Artificial Sequence: Synthetic scFv sequence"
QVQLVQSGGGLVQPGGSLRLSCAASGFTFSSYAMSWVRQAPGKGLEWVSISGSGGSTYYADSVKGRFTISRDNSKNTLYLQMNSLRAEDTAVYYCAKREAAAGHDWYFDLWGRGTLVTVSSGGGGSGGGGSGGGGSGGGGSDIRVTQSPSSLSASVGDRVTITCRASQSISSYLNWYQQKPGKAPKLLIYAASSLQSGVPSRFSGSGSGTDFTLTISSLQPEDFATYYCQQSYSIPLTFGQGTKVEIK

SEQ ID NO: 831 - protein, 250 aa, Artificial Sequence
  source: /note="Description of Artificial Sequence: Synthetic scFv sequence"
QVQLVQSGGGLVQPGGSLRLSCAASGFTFSSYWMHWVRQAPGKGLVWVSINSDGSSTSYADSVKGRFTISRDNAKNTLYLQMNSLRAEDTAVYYCVRTGWVGSYYYYMDVWGKGTTVTVSSGGGGSGGGGSGGGGSGGGGSEIVLTQSPGTLSLSPGERATLSCRASQSVSSNYLAWYQQKPGQPPRLLIYDVSTRATGIPARFSGGGSGTDFTLTISSLEPEDFAVYYCQQRSNWPPWTFGQGTKVEIK

SEQ ID NO: 832 - protein, 243 aa, Artificial Sequence
  source: /note="Description of Artificial Sequence: Synthetic scFv sequence"
QVQLVQSGGGLVQPGRSLRLSCAASGFTFDDYAMHWVRQAPGKGLEWVSISWNSGSIGYADSVKGRFTISRDNAKNSLYLQMNSLRAEDTAVYYCAKDGSSSWSWGYFDYWGQGTLVTVSSGGGGSGGGGSGGGGSSSELTQDPAVSVALGQTVRTTCQGDALRSYYASWYQQKPGQAPMLVIYGKNNRPSGIPDRFSGSDSGDTASLTITGAQAEDEADYYCNSRDSSGYPVFGTGTKVTVL

SEQ ID NO: 833 - protein, 249 aa, Artificial Sequence
  source: /note="Description of Artificial Sequence: Synthetic scFv sequence"
QVQLVQSGGGVVQPGRSLRLSCAASGFTFSSYAMHWVRQAPGKGLEWVAISYDGSNKYYADSVKGRFTISRDNSKNTLYLQMNSLRAEDTAVYYCARWKVSSSSPAFDYWGQGTLVTVSSGGGGSGGGGSGGGGSGGGGSEIVLTQSPATLSLSPGERAILSCRASQSVYTKYLGWYQQKPGQAPRLLIYDASTRATGIPDRFSGSGSGTDFTLTINRLEPEDFAVYYCQHYGGSPLITFGQGTRLEIK

SEQ ID NO: 834 - protein, 249 aa, Artificial Sequence
  source: /note="Description of Artificial Sequence: Synthetic scFv sequence"
QVQLVQSGGGVVQPGRSLRLSCAASGFTFSSYGMHWVRQAPGKGLEWVAISYDGSNKYYADSVKGRFTISRDNSKNTLYLQMNSLRAEDTAVYYCAKGYSRYYYYGMDVWGQGTTVTVSSGGGGSGGGGSGGGGSGGGGSEIVMTQSPATLSLSPGERAILSCRASQSVYTKYLGWYQQKPGQAPRLLIYDASTRATGIPDRFSGSGSGTDFTLTINRLEPEDFAVYYCQHYGGSPLITFGQGTKVDIK

SEQ ID NO: 835 - protein, 247 aa, Artificial Sequence
  source: /note="Description of Artificial Sequence: Synthetic scFv sequence"
QVQLVQSWAEVKKPGASVKVSCKASGYTFTSYYMHWVRQAPGQGLEWMGLINPSGGSTSYAQKFQGRVTMTRDTSTSTVYMELSNLRSEDTAVYYCARSPRVTTGYFDYWGQGTLVTVSSGGGGSGGGGSGGGGSGGGGSDIQLTQSPSTLSASVGDRVTITCRASQSISSWLAWYQQKPGKAPKLLIYKASSLESGVPSRFSGSGSGTEFTLTISSLQPDDFATYYCQQYSSYPLTFGGGTRLEIK

SEQ ID NO: 836 - protein, 246 aa, Artificial Sequence
  source: /note="Description of Artificial Sequence: Synthetic scFv sequence"
QITLKESGPALVKPTQTLTLTCTFSGFSLSTAGVHVGWIRQPPGKALEWLALISWADDKRYRPSLRSRLDITRVTSKDQVVLSMTNMQPEDTATYYCALQGFDGYEANWGPGTLVTVSSGGGGSGGGGSGGGGSGGGGSDIVMTQSPSSLSASAGDRVTITCRASRGISSALAWYQQKPGKPPKLLIYDASSLESGVPSRFSGSGSGTDFTLTIDSLEPEDFATYYCQQSYSTPWTFGQGTKVDIK

SEQ ID NO: 837 - protein, 493 aa, Artificial Sequence
  source: /note="Description of Artificial Sequence: Synthetic scFv sequence"
MALPVTALLLPLALLLHAARPEVQLQQSGGERATPGASVKMSCKTSGYTFTNYWMHWVKQRPGQGLEWIGYINPSSGYTQYNQKFKDKATLTADKSSSTAYIQLSSLTSEDSAVYYCSTYYGDYLFPYWGQGTLVTVSAGGGGSGGGGSGGGGSDVLMTQTPLSLPVSLGDQASISCRSSQDIVYGNGNTYLEWYLQKPGQSPKLLIYKVSNRFSGVPDRFSGSGSGTDFTLKISRVEAEDLGVYYCFQGSHVPYTFGGGTKLEIKRAAAIEVEQKLISEEDLLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 838 - protein, 487 aa, Artificial Sequence
  source: /note="Description of Artificial Sequence: Synthetic scFv sequence"
MALPVTALLLPLALLLHAARPEVQLQQSGGERATPGASVKMSCKTSGYTFTNYWMHWVKQRPGQGLEWIGYINPSSGYTQYNQKFKDKATLTADKSSSTAYIQLSSLTSEDSAVYYCSTYYGDYLFPYWGQGTLVTVSAGGGGSGGGGSGGGGSDVLMTQTPLSLPVSLGDQASISCRSSQDIVYGNGNTYLEWYLQKPGQSPKLLIYKVSNRFSGVPDRFSGSGSGTDFTLKISRVEAEDLGVYYCFQGSHVPYTFGGGTKLEIKRAAAIEFMYPPPYLDNERSNGTIIHIKEKHLCHTQSSPKLFWALVVVAGVLFCYGLLVTVALCVIWTNSRRNRLLQSDYMNMTPRRPGLTRKPYQPYAPARDFAAYRPRAKFSRSAETAANLQDPNQLYNELNLGRREEYDVLEKKRARDPEMGGKQQRRRNPQEGVYNALQKDKMAEAYSEIGTKGERRRGKGHDGLYQGLSTATKDTYDALHMQTLAPR

SEQ ID NO: 839 - protein, 252 aa, Artificial Sequence
  source: /note="Description of Artificial Sequence: Synthetic scFv sequence"
EIVLTQSPATLSLSPGERATLSCRASQSVSSYLAWYQQKPGQAPRLLIYDASNRATGIPARFSGSGSGTDFTLTISSLEPEDFAVYYCQQSSNWPRTFGQGTKVEIKRGSTSGSGKPGSGEGSTKGQVQLVESGGGVVQPGRSLRLDCKASGITFSNSGMHWVRQAPGKGLEWVAVIWYDGSKRYYADSVKGRFTISRDNSKNTLFLQMNSLRAEDTAVYYCATNDDYWGQGTLVTVSSSSGGGGSGGGGSC

SEQ ID NO: 840 - protein, 241 aa, Artificial Sequence
  source: /note="Description of Artificial Sequence: Synthetic scFv sequence"
VQLQESGPDLVKPSQSLSLTCTVTGYSITSGYSWHWIRQFPGNKLEWMGYIHYSGDTDYNPSLKSRFSITRDTSKNQFFLQLNSVTTEDTATYYCATPGGFVYWGQGTLVTVSAGGGGSGGGGSGGGGSDVVMTQTPLTLSVTIGQPASISCKSSQSLLDSDGKTYLHWLLQRPGQSPKRLIFLVSKLDSGVPDRFTGSGSGTDFTLKISRVEAEDLGVYYCWQGTHFPQTFGGGTKLEIK

SEQ ID NO: 841 - protein, 112 aa, Artificial Sequence
  source: /note="Description of Artificial Sequence: Synthetic scFv sequence"
DVVMTQTPLTLSVTIGQPASISCKSSQSLLDSDGKTYLHWLLQRPGQSPKRLIFLVSKLDSGVPDRFTGSGSGTDFTLKISRVEAEDLGVYYCWQGTHFPQTFGGGTKLEIK

SEQ ID NO: 842 - protein, 114 aa, Artificial Sequence
  source: /note="Description of Artificial Sequence: Synthetic scFv sequence"
VQLQESGPDLVKPSQSLSLTCTVTGYSITSGYSWHWIRQFPGNKLEWMGYIHYSGDTDYNPSLKSRFSITRDTSKNQFFLQLNSVTTEDTATYYCATPGGFVYWGQGTLVTVSA

SEQ ID NO: 843 - protein, 112 aa, Artificial Sequence
  source: /note="Description of Artificial Sequence: Synthetic scFv sequence"
DVVMTQTPLSLPVSLGDQASISCRSSQSLLKNNGNTFLHWYLQKSGQSPKLLIYKVSNRLSGVPDRFSGSGSGTYFTLKISRVEAEDLGVYFCSQSTHIPYTFGGGTKLEIK

SEQ ID NO: 844 - protein, 47 aa, Artificial Sequence
  source: /note="Description of Artificial Sequence: Synthetic scFv sequence"
EVKLVESGGGLVLPGDSLRLSCATSEFTFTDYYMTWVRQPPRKALEW

SEQ ID NO: 845 - protein, 219 aa, Artificial Sequence
  source: /note="Description of Artificial Sequence: Synthetic scFv sequence"
DIQMTQSPDSLPVTPGEPASISCRSSQSLLHSNGYNYLDWYLQKAGQSPQLLIYLGSNRASGVPDRFSGSGSGTDFTLKISRVEAEDVGVYYCQQYYNHPTTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 846 - protein, 240 aa, Artificial Sequence
  source: /note="Description of Artificial Sequence: Synthetic scFv sequence"
QVQLQQSGAEVKKPGASVKVSCKASGYTFTGYYMHWVRQAPGQGLEWMGRINPNSGGTNYAQKFQGRVTMTRDTSISTAYMELSRLRSEDTAVYYCARGRYYGMDVWGQGTMVTVSSGGGGSGGGGSGGGGSGGGGSEIVLTQSPATLSLSPGERATISCRASQSVSSNFAWYQQRPGQAPRLLIYDASNRATGIPPRFSGSGSGTDFTLTISSLEPEDFAAYYCHQRSNWLYTFGQGTK

SEQ ID NO: 847 - protein, 253 aa, Artificial Sequence
  source: /note="Description of Artificial Sequence: Synthetic scFv sequence"
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCARYRLIAVAGDYYYYGMDVWGQGTMVTVSSGGGGSGGGGSGGGGSGGGGSDIQMTQSPSSVSASVGDRVTITCRASQGVGRWLAWYQQKPGTAPKLLIYAASTLQSGVPSRFSGSGSGTDFTLTINNLQPEDFATYYCQQANSFPLTFGGGTRLEIK

SEQ ID NO: 848 - protein, 255 aa, Artificial Sequence
  source: /note="Description of Artificial Sequence: Synthetic scFv sequence"
QVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCARVAGGIYYYYGMDVWGQGTTITVSSGGGGSGGGGSGGGGSGGGGSDIVMTQTPDSLAVSLGERATISCKSSHSVLYNRNNKNYLAWYQQKPGQPPKLLFYWASTRKSGVPDRFSGSGSGTDFTLTISSLQPEDFATYFCQQTQTFPLTFGQGTRLEIN

SEQ ID NO: 849 - protein, 241 aa, Artificial Sequence
  source: /note="Description of Artificial Sequence: Synthetic scFv sequence"
QVQLQQSGAEVKKPGASVKVSCKASGYTFTGYYMHWVRQAPGQGLEWMGWINPNSGGTNYAQNFQGRVTMTRDTSISTAYMELRRLRSDDTAVYYCASGWDFDYWGQGTLVTVSSGGGGSGGGGSGGGGSGGGGSDIRMTQSPSSLSASVGDRVTITCRASQSIRYYLSWYQQKPGKAPKLLIYTASILQNGVPSRFSGSGSGTDFTLTISSLQPEDFATYYCLQTYTTPDFGPGTKVEIK

SEQ ID NO: 850 - protein, 246 aa, Artificial Sequence
  source: /note="Description of Artificial Sequence: Synthetic scFv sequence"
QVQLVQSGAEVKKPGASVKVSCKASGYTFTGYYMHWVRQAPGQGLEWMGRINPNSGGTNYAQKFQGRVTMTTDTSTSTAYMELRSLRSDDTAVYYCARTTTSYAFDIWGQGTMVTVSSGGGGSGGGGSGGGGSGGGGSDIQLTQSPSTLSASVGDRVTITCRASQSISTWLAWYQQKPGKAPNLLIYKASTLESGVPSRFSGSGSGTEFTLTISSLQPDDFATYYCQQYNTYSPYTFGQGTKLEIK

SEQ ID NO: 851 - protein, 249 aa, Artificial Sequence
  source: /note="Description of Artificial Sequence: Synthetic scFv sequence"
QVQLVQSGGGLVKPGGSLRLSCEASGFIFSDYYMGWIRQAPGKGLEWVSYIGRSGSSMYYADSVKGRFTFSRDNAKNSLYLQMNSLRAEDTAVYYCAASPVVAATEDFQHWGQGTLVTVSSGGGGSGGGGSGGGGSGGGGSDIVMTQTPATLSLSPGERATLSCRASQSVTSNYLAWYQQKPGQAPRLLLFGASTRATGIPDRFSGSGSGTDFTLTINRLEPEDFAMYYCQQYGSAPVTFGQGTKLEIK

SEQ ID NO: 852 - protein, 249 aa, Artificial Sequence
  source: /note="Description of Artificial Sequence: Synthetic scFv sequence"
QVQLVQSGAEVRAPGASVKISCKASGFTFRGYYIHWVRQAPGQGLEWMGIINPSGGSRAYAQKFQGRVTMTRDTSTSTVYMELSSLRSDDTAMYYCARTASCGGDCYYLDYWGQGTLVTVSSGGGGSGGGGSGGGGSGGGGSDIQMTQSPPTLSASVGDRVTITCRASENVNIWLAWYQQKPGKAPKLLIYKSSSLASGVPSRFSGSGSGAEFTLTISSLQPDDFATYYCQQYQSYPLTFGGGTKVDIK

SEQ ID NO: 853 - protein, 244 aa, Artificial Sequence
  source: /note="Description of Artificial Sequence: Synthetic scFv sequence"
QVQLVQSGGGLVQPGRSLRLSCAASGFTFDDYAMHWVRQAPGKGLEWVSGISWNSGSIGYADSVKGRFTISRDNAKNSLYLQMNSLRAEDTAVYYCAKDGSSSWSWGYFDYWGQGTLVTVSSGGGGSGGGGSGGGGSSSELTQDPAVSVALGQTVRTTCQGDALRSYYASWYQQKPGQAPMLVIYGKNNRPSGIPDRFSGSDSGDTASLTITGAQAEDEADYYCNSRDSSGYPVFGTGTKVTVL

SEQ ID NO: 854 - protein, 246 aa, Artificial Sequence
  source: /note="Description of Artificial Sequence: Synthetic scFv sequence"
EVQLVESGGGLVQPGRSLRLSCAASGFTFDDYAMHWVRQAPGKGLEWVSGISWNSGSTGYADSVKGRFTISRDNAKNSLYLQMNSLRAEDTALYYCAKDSSSWYGGGSAFDIWGQGTMVTVSSGGGGSGGGGSGGGGSSSELTQEPAVSVALGQTVRITCQGDSLRSYYASWYQQKPGQAPVLVIFGRSRRPSGIPDRFSGSSSGNTASLIITGAQAEDEADYYCNSRDNTANHYVFGTGTKLTVL

SEQ ID NO: 855 - protein, 246 aa, Artificial Sequence
  source: /note="Description of Artificial Sequence: Synthetic scFv sequence"
EVQLVESGGGLVQPGRSLRLSCAASGFTFDDYAMHWVRQAPGKGLEWVSGISWNSGSTGYADSVKGRFTISRDNAKNSLYLQMNSLRAEDTALYYCAKDSSSWYGGGSAFDIWGQGTMVTVSSGGGGSGGGGSGGGGSSSELTQDPAVSVALGQTVRITCQGDSLRSYYASWYQQKPGQAPVLVIYGKNNRPSGIPDRFSGSSSGNTASLTITGAQAEDEADYYCNSRGSSGNHYVFGTGTKVTVL

SEQ ID NO: 856 - protein, 251 aa, Artificial Sequence
  source: /note="Description of Artificial Sequence: Synthetic scFv sequence"
QVQLVQSGGGLVQPGGSLRLSCAASGFTFSSYWMHWVRQAPGKGLVWVSRINSDGSSTSYADSVKGRFTISRDNAKNTLYLQMNSLRAEDTAVYYCVRTGWVGSYYYYMDVWGKGTTVTVSSGGGGSGGGGSGGGGSGGGGSEIVLTQSPGTLSLSPGERATLSCRASQSVSSNYLAWYQQKPGQPPRLLIYDVSTRATGIPARFSGGGSGTDFTLTISSLEPEDFAVYYCQQRSNWPPWTFGQGTKVEIK

SEQ ID NO: 857 - protein, 250 aa, Artificial Sequence
  source: /note="Description of Artificial Sequence: Synthetic scFv sequence"
QVQLVQSGGGVVQPGRSLRLSCAASGFTFSSYGMHWVRQAPGKGLEWVAVISYDGSNKYYADSVKGRFTISRDNSKNTLYLQMNSLRAEDTAVYYCAKGYSRYYYYGMDVWGQGTTVTVSSGGGGSGGGGSGGGGSGGGGSEIVMTQSPATLSLSPGERAILSCRASQSVYTKYLGWYQQKPGQAPRLLIYDASTRATGIPDRFSGSGSGTDFTLTINRLEPEDFAVYYCQHYGGSPLITFGQGTKVDIK

SEQ ID NO: 858 - protein, 253 aa, Artificial Sequence
  source: /note="Description of Artificial Sequence: Synthetic scFv sequence"
QVQLVQSGAEVKKPGASVKVSCKASGYTFTGYYMHWVRQAPGQGLEWMGWINPNSGGTNYAQKFQGRVTMTRDTSISTAYMELSRLRSDDTAVYYCARDLRRTVVTPRAYYGMDVWGQGTTVTVSSGGGGSGGGGSGGGGSGGGGSDIQLTQSPSTLSASVGDRVTITCQASQDISNSLNWYQQKAGKAPKLLIYDASTLETGVPSRFSGSGSGTDFSFTISSLQPEDIATYYCQQHDNLPLTFGQGTKVEIK

SEQ ID NO: 859 - protein, 249 aa, Artificial Sequence
  source: /note="Description of Artificial Sequence: Synthetic scFv sequence"
QVQLVQSGGGLVQPGGSLRLSCAASGFTFSSYAMSWVRQAPGKGLEWVSAISGSGGSTYYADSVKGRFTISRDNSKNTLYLQMNSLRAEDTAVYYCAKREAAAGHDWYFDLWGRGTLVTVSSGGGGSGGGGSGGGGSGGGGSDIRVTQSPSSLSASVGDRVTITCRASQSISSYLNWYQQKPGKAPKLLIYAASSLQSGVPSRFSGSGSGTDFTLTISSLQPEDFATYYCQQSYSIPLTFGQGTKVEIK

SEQ ID NO: 860 - protein, 247 aa, Artificial Sequence
  source: /note="Description of Artificial Sequence: Synthetic scFv sequence"
QVQLVQSWAEVKKPGASVKVSCKASGYTFTSYYMHWVRQAPGQGLEWMGIINPSGGSTSYAQKFQGRVTMTRDTSTSTVYMELSNLRSEDTAVYYCARSPRVTTGYFDYWGQGTLVTVSSGGGGSGGGGSGGGGSGGGGSDIQLTQSPSTLSASVGDRVTITCRASQSISSWLAWYQQKPGKAPKLLIYKASSLESGVPSRFSGSGSGTEFTLTISSLQPDDFATYYCQQYSSYPLTFGGGTRLEIK

SEQ ID NO: 861 - protein, 253 aa, Artificial Sequence
  source: /note="Description of Artificial Sequence: Synthetic scFv sequence"
QVQLVQSGAEVRRPGASVKISCRASGDTSTRHYIHWLRQAPGQGPEWMGVINPTTGPATGSPAYAQMLQGRVTMTRDTSTRTVYMELRSLRFEDTAVYYCARSVVGRSAPYYFDYWGQGTLVTVSSGGGGSGGGGSGGGGSGGGGSDIQMTQSPSSLSASVGDRVTITCRASQGISDYSAWYQQKPGKAPKLLIYAASTLQSGVPSRFSGSGSGTDFTLTISYLQSEDFATYYCQQYYSYPLTFGGGTKVDIK

SEQ ID NO: 862 - protein, 249 aa, Artificial Sequence
  source: /note="Description of Artificial Sequence: Synthetic scFv sequence"
QVQLQQSGAEVKKPGASVKVSCKASGYTFTNYYMHWVRQAPGQGLEWMGIINPSGGYTTYAQKFQGRLTMTRDTSTSTVYMELSSLRSEDTAVYYCARIRSCGGDCYYFDNWGQGTLVTVSSGGGGSGGGGSGGGGSGGGGSDIQLTQSPSTLSASVGDRVTITCRASENVNIWLAWYQQKPGKAPKLLIYKSSSLASGVPSRFSGSGSGAEFTLTISSLQPDDFATYYCQQYQSYPLTFGGGTKVDIK

SEQ ID NO: 863 - protein, 246 aa, Artificial Sequence
  source: /note="Description of Artificial Sequence: Synthetic scFv sequence"
QVQLVQSGAEVKKPGAPVKVSCKASGYTFTGYYMHWVRQAPGQGLEWMGWINPNSGGTNYAQKFQGRVTMTRDTSISTAYMELSRLRSDDTAVYYCARGEWDGSYYYDYWGQGTLVTVSSGGGGSGGGGSGGGGSGGGGSDIVLTQTPSSLSASVGDRVTITCRASQSINTYLNWYQHKPGKAPKLLIYAASSLQSGVPSRFSGSGSGTDFTLTISSLQPEDFATYYCQQSFSPLTFGGGTKLEIK

SEQ ID NO: 864 - protein, 242 aa, Artificial Sequence
  source: /note="Description of Artificial Sequence: Synthetic scFv sequence"
QVQLVESGGGLVQPGGSLRLSCAASGFTFSSYWMHWVRQVPGKGLVWVSRINTDGSTTTYADSVEGRFTISRDNAKNTLYLQMNSLRDDDTAVYYCVGGHWAVWGQGTTVTVSSGGGGSGGGGSGGGGSGGGGSDIQMTQSPSTLSASVGDRVTITCRASQSISDRLAWYQQKPGKAPKLLIYKASSLESGVPSRFSGSGSGTEFTLTISSLQPDDFAVYYCQQYGHLPMYTFGQGTKVEIK

SEQ ID NO: 865 - protein, 241 aa, Artificial Sequence
  source: /note="Description of Artificial Sequence: Synthetic scFv sequence"
QVQLVQSGAEVEKPGASVKVSCKASGYTFTDYYMHWVRQAPGQGLEWMGWINPNSGGTNYAQKFQGRVTMTRDTSISTAYMELSRLRSDDTAVYYCASGWDFDYWGQGTLVTVSSGGGGSGGGGSGGGGSGGGGSDIVMTQSPSSLSASVGDRVTITCRASQSIRYYLSWYQQKPGKAPKLLIYTASILQNGVPSRFSGSGSGTDFTLTISSLQPEDFATYYCLQTYTTPDFGPGTKVEIK

SEQ ID NO: 866 - protein, 250 aa, Artificial Sequence
  source: /note="Description of Artificial Sequence: Synthetic scFv sequence"
QVQLVQSGGGVVQPGRSLRLSCAASGFTFSSYAMHWVRQAPGKGLEWVAVISYDGSNKYYADSVKGRFTISRDNSKNTLYLQMNSLRAEDTAVYYCARWKVSSSSPAFDYWGQGTLVTVSSGGGGSGGGGSGGGGSGGGGSEIVLTQSPATLSLSPGERAILSCRASQSVYTKYLGWYQQKPGQAPRLLIYDASTRATGIPDRFSGSGSGTDFTLTINRLEPEDFAVYYCQHYGGSPLITFGQGTRLEIK

SEQ ID NO: 867 - protein, 246 aa, Artificial Sequence
  source: /note="Description of Artificial Sequence: Synthetic scFv sequence"
QVQLQQSGAEVKKPGASVKVSCKTSGYPFTGYSLHWVRQAPGQGLEWMGWINPNSGGTNYAQKFQGRVTMTRDTSISTAYMELSRLRSDDTAVYYCARDHYGGNSLFYWGQGTLVTVSSGGGGSGGGGSGGGGSGGGGSDIQLTQSPSSISASVGDTVSITCRASQDSGTWLAWYQQKPGKAPNLLMYDASTLEDGVPSRFSGSASGTEFTLTVNRLQPEDSATYYCQQYNSYPLTFGGGTKVDIK

SEQ ID NO: 868 - protein, 248 aa, Artificial Sequence
  source: /note="Description of Artificial Sequence: Synthetic scFv sequence"
QVQLVQSGAEVKKPGASVEVSCKASGYTFTSYYMHWVRQAPGQGLEWMGIINPSGGSTGYAQKFQGRVTMTRDTSTSTVHMELSSLRSEDTAVYYCARGGYSSSSDAFDIWGQGTMVTVSSGGGGSGGGGSGGGGSGGGGSDIQMTQSPPSLSASVGDRVTITCRASQDISSALAWYQQKPGTPPKLLIYDASSLESGVPSRFSGSGSGTDFTLTISSLQPEDFATYYCQQFSSYPLTFGGGTRLEIK

SEQ ID NO: 869 - protein, 262 aa, Artificial Sequence
  source: /note="Description of Artificial Sequence: Synthetic scFv sequence"
FGLRWVFLVAILKGVQCEVQLLESGGGLVQPGGSLRLSCAASGFTFSNFGMTWVRQAPGKGLEWVSGVSIRGIATYYADSVKGRFTISRDDSRNTLYLQMNSLRAEDTALYYCATGVRLLGREWGQGTLVTVSSGGGGSGGGGSGGGGSDVVMTQSPLSLPVPLGQPASISCRSSQSLVDNDGNTYLNWFQQRPGQSPRRLIYKVSMRDSGVPDRFTGSGSGTDFTLRISRVEADDVGVYYCMQGTHWPLTFGPGTKVEIKR

SEQ ID NO: 870 - protein, 115 aa, Artificial Sequence
  source: /note="Description of Artificial Sequence: Synthetic scFv sequence"
EVQLVESGGGLVQAGGSLRLSCAASGSTFSQYDVGWYRQAPGKQRELVAFSSSGGRTIYPDSVKGRFTFSRDNTKNTVYLQMTSLKPEDTAVYYCKIDWYLNSYWGQGTQVTVSS

SEQ ID NO: 871 - protein, 114 aa, Artificial Sequence
  source: /note="Description of Artificial Sequence: Synthetic scFv sequence"
EVQLVESGGGLVQAGGSLRLSCAASGVDASNSAMGWYRQAPGKQREWVARITGGGLIAYTDSVKGRFTISRDNAKSTVYLQMNSLEPEDTAVYYCNTINSRDGWGQGTQVTVSS

SEQ ID NO: 872 - protein, 111 aa, Artificial Sequence
  source: /note="Description of Artificial Sequence: Synthetic scFv sequence"
EVQLVESGGGLVQAGGSLTISCAASGITFSDSIVSWYRRARGKQREWVAGISNGGTTKYAESVLGRFTISRDNAKNMVYLQMNGLNPEDTAVYLCKVRQYWGQGTQVTVSS

SEQ ID NO: 873 - protein, 124 aa, Artificial Sequence
  source: /note="Description of Artificial Sequence: Synthetic scFv sequence"
EVQLVESGGGLVQPGGSLRLSCAASGFTFDYYAIGWFRQAPGKAREGVSCISGGDNSTYYADSVKGRFTISRDNAKNTVYLQMNSLKPEDTAVYYCATGGWKYCSGYDPEYIYWGQGTQVTVSS

SEQ ID NO: 874 - protein, 126 aa, Artificial Sequence
  source: /note="Description of Artificial Sequence: Synthetic scFv sequence"
EVQLVESGGGLVQPGGSLRLSCAASGFTLDYYAIGWFRQAPGKEREWASSISSSDGSTYYADSVKGRFTISRDNAKNTVFLQMNSLKPEDTAVYSCAASQAPITIATMMKPFYDYWGQGTQVTVSS

SEQ ID NO: 875 - protein, 123 aa, Artificial Sequence
  source: /note="Description of Artificial Sequence: Synthetic scFv sequence"
EVQLVESGGGLVQPGGSLRLSCAASGFTLDYYAKCWFRQAPGKEREWVSCISSSDGSTYYADSVKGRFTISRDNAKNTVYLQMNSLKPEDTAVYFCAARHGGPLTVEYFFDYWGQGTQVTVSS

SEQ ID NO: 876 - protein, 114 aa, Artificial Sequence
  source: /note="Description of Artificial Sequence: Synthetic scFv sequence"
EVQLVESGGGLVEPGGSLRLSCVASGFTFSSYDMSWVRQAPGKGLEWVSTINSGGGITYRGSVKGRFTISRDNAKNTLYLQMNSLKPEDTAVYYCENGGSSYRRGQGTQVTVSS

SEQ ID NO: 877 - protein, 120 aa, Artificial Sequence
  source: /note="Description of Artificial Sequence: Synthetic scFv sequence"
EVQLVESGGGLVQAGGSLRLSCAASGRTFSSGTMGWFRRAPGKEREFVASIPWSGGRTYYADSVKDRFTISRDNAQNTVFLQMNSLKPEDTAVYYCAFKERSTGWDFASWGQGIQVTVSS

SEQ ID NO: 878 - protein, 119 aa, Artificial Sequence
  source: /note="Description of Artificial Sequence: Synthetic scFv sequence"
EVQLVESGGGLVQAGGSLRLSCAASGSTFSNYVSNYAMGWGRQAPGTQRELVASISNGDTTNYADSVKGRFTISRDNAKNTVYLQMNSLKPEDTAVYYCFEHQVAGLTWGQGTQVTVSS

SEQ ID NO: 879 - protein, 118 aa, Artificial Sequence
  source: /note="Description of Artificial Sequence: Synthetic scFv sequence"
  MOD_RES (27)..(27): Any amino acid
  MOD_RES (32)..(32): Any amino acid
  MOD_RES (75)..(75): Any amino acid
EVQLVESGGGLVQAGGSLRLSCVASGXALKIXVMGWYRQAPGKQRELVAAITSGGRTNYSDSVKGRFTISGDNAXNTVYLQMNSLKSEDTAVYYCREWNSGYPPVDYWGQGTQVTVSS

SEQ ID NO: 880 - protein, 113 aa, Artificial Sequence
  source: /note="Description of Artificial Sequence: Synthetic scFv sequence"
EVQLVESGGGLVQPGGSLRLSCAASGFTFSTYTMIWLRRAPGKGFEWVSTIDKDGNTNYVDSVKGRFAVSRDNTKNTLYLQMNSLKPEDTAMYYCTKHGSSARGQGTRVTVSS

SEQ ID NO: 881 - protein, 127 aa, Artificial Sequence
  source: /note="Description of Artificial Sequence: Synthetic scFv sequence"
EVQLVESGGGLVQTGGSLRLSCAASGFTLDYYGIGWFRQAPGKEREGVSFISGSDGSTYYAESVKGRFTISRDKAKNTVYLQMNSLKPEDTAVYYCAADPWGPPSIATMTSYEYKHWGQGTQVTVSS

SEQ ID NO: 882 - protein, 247 aa, Artificial Sequence
  source: /note="Description of Artificial Sequence: Synthetic scFv sequence"
DIQLTQSPSSLSASVGDRVTITCRASQSISSYLNWYQQKPGKAPKLLIYAASSLQSGVPSRFSGSGSGTDFTLTISSLQPEDFATYYCQQSYSTPRTFGQGTKVEIKRSRGGGGSGGGGSGGGGSLEMAQVQLVQSGAEVKKPGASVKVSCKASGYTFSSYGISWVRQAPGQGLEWMGWISPYNGNTNYAQNLQGRVTMTTDTSTTTAYMELRSLTSDDTAVYYCARYSGYYYVDYWGQGTLVTVSS

SEQ ID NO: 883 - protein, 251 aa, Artificial Sequence
  source: /note="Description of Artificial Sequence: Synthetic scFv sequence"
KLLPVLTQPHSVSESPGKTVTISCTGSSGSIASNFVQWYQQRPGSAPTTVIYDDNQRPSGVPDRFSASIDRSSNSASLTISGLKTDDEADYYCQSYDGSNVIFGGGTKLTVLGSRGGGGSGGGGSGGGGSLEMAEVQLVESGAEVKKPGASVKVSCKASGYTFTSYYMHWVRQAPGQGLEWMGIINPSGGSTSYAQKFQGRVTMTRDTSTSTVYMELSSLRSEDTAVYYCAAGSYYSLDIWGQGTMVTVSS

SEQ ID NO: 884 - protein, 251 aa, Artificial Sequence
  source: /note="Description of Artificial Sequence: Synthetic scFv sequence"
KLLPVLTQPPSVSVAPGKTARITCGGNNIGSKSVHWYQQKPGQAPVLVIYYDSDRPSGIPERFSGSNSGNTATLTISRVEAGDEADYYCQVWDSITDHYVFGTGTKVTVLGSRGGGGSGGGGSGGGGSLEMAEVQLVESGAEVKKPGSSVKVSCKASGGTFSSYAISWVRQAPGQGLEWMGRIIPILGIANYAQKFQGRVTITADKSTSTAYMELSSLRSEDTAVYYCARQGYVWSEMDFWGQGTLVTVSS

SEQ ID NO: 885 - protein, 250 aa, Artificial Sequence
  source: /note="Description of Artificial Sequence: Synthetic scFv sequence"
QAVLTQPPSASGTPGQRVTISCSGSSSNIGSNTVNWYQQLPGTAPKLLIYSNNQRPSGVPDRFSGSKSGTSASLAISGLQSEDEADYYCAAWDDSLNGSYVFGTGTKVTVLGSRGGGGSGGGGSGGGGSLEMAQVQLVQSGAEVRKPGASVKVSCKASGGTFSSYAISWVRQAPGQGLEWMGRIIPILGIANYAQKFQGRVTITADKSTSTAYMELSSLRSEDTAVYYCARHYGQWWDYWGQGTLVTVSS

SEQ ID NO: 886 - protein, 247 aa, Artificial Sequence
  source: /note="Description of Artificial Sequence: Synthetic scFv sequence"
QPVLTQPPSVSVAPGETASVSCGGNNFGSQSVHWYQQKSGQAPLLVIYYDQDRPSEIPARFSGSKSGNTATLTISRVEAGDEADYYCQVWDTYTDHVVFGGGTKLTVLGSRGGGGSGGGGSGGGGSLEMAEVQLVQSGAEVEKPGASVKVSCKASGYTFSSYYMDWVRQAPGQGLEWMGRINPTSGSTTYAQKFQGRVTMTRDTSTFTVYMDLSSLRSEDTAVYYCARSGGGYGDSWGQGTLVTVSS

SEQ ID NO: 887 - protein, 249 aa, Artificial Sequence
  source: /note="Description of Artificial Sequence: Synthetic scFv sequence"
QSVLTQPPSVSGAPGQRVTISCTGSSSNIGAGFDVHWYQQLPGTAPKLLIFGNSNRPSGVPDRFSGSKSGTSASLAITGLQAEDEADYYCQSYDSSLSGYVFGSGTKVTVLGSRGGGGSGGGGSGGGGSLEMAEVQLVESGAEVKKPGSSVKVSCKASGGTFSSYAISWVRQAPGQGLEWMGRIIPIFGIANYAQKFQGRVTITADKSTSTAYMELSSLRSEDTAVYYCARSMWYMDSWGQGTLVTVSS

SEQ ID NO: 888 - protein, 249 aa, Artificial Sequence
  source: /note="Description of Artificial Sequence: Synthetic scFv sequence"
QSVVTQPPAVSGALGQRVTISCTGTTSNIGAGFDVHWYQQRPGAAPKLLISGNTHRPSGVPDRISGSKSGTLASLAITGLQAEDEADYYCQSYDRSLSTILFGGGTKLTVLGSRGGGGSGGGGSGGGGSLEMAQVQLVQSGAEVKKPGSSVKVSCKASGGTFSSHPISWVRQAPGQGLEWMGRIIPMLDIPNNAQKFQGRVTITADKSTDTAYLELSSLTSEDTAVYYCARGLYYYDYWGQGTLVTVSS

SEQ ID NO: 889 - protein, 253 aa, Artificial Sequence
  source: /note="Description of Artificial Sequence: Synthetic scFv sequence"
METDTLLLWVLLLWVPGSTGDIVMTQSPSSLSASVGDRVTITCKASQDVGTAVDWYQQKPGKAPKLLIYWASTRHTGVPDRFTGSGSGTDFTLTISSLQPEDFADYFCQQYNSYPLTFGGGTKLEIKGGGSGGGGEVQLVQSGAEVKKPGASVKISCKTSGYTFTEYTIHWVKQASGKGLEWIGNINPNNGGTTYNQKFEDRATLTVDKSTSTAYMELSSLRSEDTAVYYCAAGWNFDYWGQGTTVTVSSGGC

SEQ ID NO: 890 - protein, 250 aa, Artificial Sequence
  source: /note="Description of Artificial Sequence: Synthetic scFv sequence"
METDTLLLWVLLLWVPGSTGDIVMTQSPSSLSASVGDRVTITCKASQDVGTAVDWYQQKPGKAPKLLIYWASTRHTGVPDRFTGSGSGTDFTLTISSLQPEDFADYFCQQYNSYPLTFGGGTKLEIKSGGGGEVQLVQSGAEVKKPGASVKISCKTSGYTFTEYTIHWVKQASGKGLEWIGNINPNNGGTTYNQKFEDRATLTVDKSTSTAYMELSSLRSEDTAVYYCAAGWNFDYWGQGTTVTVSSGGC

SEQ ID NO: 891 - protein, 253 aa, Artificial Sequence
  source: /note="Description of Artificial Sequence: Synthetic scFv sequence"
METDTLLLWVLLLWVPGSTGEVQLVQSGAEVKKPGASVKISCKTSGYTFTEYTIHWVKQASGKGLEWIGNINPNNGGTTYNQKFEDRATLTVDKSTSTAYMELSSLRSEDTAVYYCAAGWNFDYWGQGTTVTVSSGGGSGGGGDIVMTQSPSSLSASVGDRVTITCKASQDVGTAVDWYQQKPGKAPKLLIYWASTRHTGVPDRFTGSGSGTDFTLTISSLQPEDFADYFCQQYNSYPLTFGGGTKLEIKGGC

SEQ ID NO: 892 - protein, 250 aa, Artificial Sequence
  source: /note="Description of Artificial Sequence: Synthetic scFv sequence"
METDTLLLWVLLLWVPGSTGEVQLVQSGAEVKKPGASVKISCKTSGYTFTEYTIHWVKQASGKGLEWIGNINPNNGGTTYNQKFEDRATLTVDKSTSTAYMELSSLRSEDTAVYYCAAGWNFDYWGQGTTVTVSSSGGGGDIVMTQSPSSLSASVGDRVTITCKASQDVGTAVDWYQQKPGKAPKLLIYWASTRHTGVPDRFTGSGSGTDFTLTISSLQPEDFADYFCQQYNSYPLTFGGGTKLEIKGGC

SEQ ID NO: 893 - protein, 242 aa, Artificial Sequence
  source: /note="Description of Artificial Sequence: Synthetic scFv sequence"
DIQMTQSPSAMSASVGDRVTITCRASKSISKYLAWFQQKPGKVPKLRIHSGSTLQSGVPSRFSGSGSGTEFTLTISSLQPEDFATYYCQQHIEYPWTFGQGTKVEIKRGGGGSGGGGSGGGGSEVQLVQSGAEVKKPGATVKISCKASGYTFTDYYMHWVQQAPGKGLEWMGYFNPYNDYTRYAEKFQGRVTITADTSTDTAYMELSSLRSEDTAVYYCARSDGYYDAMDYWGQGTTVTVSS

SEQ ID NO: 894 - protein, 242 aa, Artificial Sequence
  source: /note="Description of Artificial Sequence: Synthetic scFv sequence"
DIQMTQSPSAMSASVGDRVTITCRASKSISKYLAWFQQKPGKVPKLRIHSGSTLQSGVPSRFSGSGSGTEFTLTISSLQPEDFATYYCQQHIEYPWTFGQGTKVEIKRGGGGSGGGGSGGGGSQVQLVQSGAEVKKPGASVKVSCKASGYTFTDYYMHWVRQAPGQGLEWMGYFNPYNDYTRYAQKFQGRVTMTRDTSISTAYMELSSLRSDDTAVYYCARSDGYYDAMDYWGQGTTVTVSS

SEQ ID NO: 895 - protein, 244 aa, Artificial Sequence
  source: /note="Description of Artificial Sequence: Synthetic scFv sequence"
DVQITQSPSYLAASPGETITINCRASKSISKYLAWYQEKPGKANKLLIHSGSTLQSGIPSRFSGSGSGTDFTLTISSLEPEDFAMYYCQQHIEYPWTFGGGTKLEIKRAGGGGSGGGGSSGGGGSEIQLQQSGPELVKPGASVKMSCKASGYTFTDYYMHWVKQNNGESLEWIGYFNPYNDYTRYNQNFNGKATLTVDKSSSTAYMQLNSLTSEDSAFYYCARSDGYYDAMDYWGQGTSVTVSS

SEQ ID NO: 896 - protein, 245 aa, Artificial Sequence
  source: /note="Description of Artificial Sequence: Synthetic scFv sequence"
EIQLQQSGPELVKPGASVKMSCKASGYTFTDYYMHWVKQNNGESLEWIGYFNPYNDYTRYNQNFNGKATLTVDKSSSTAYMQLNSLTSEDSAFYYCARSDGYYDAMDYWGQGTSVTVSSGGGGSGGGGSSGGGGSDVQITQSPSYLAASPGETITINCRASKSISKYLAWYQEKPGKANKLLIHSGSTLQSGIPSRFSGSGSGTDFTLTISSLEPEDFAMYYCQQHIEYPWTFGGGTKLEIKRAS

SEQ ID NO: 897 - protein, 244 aa, Artificial Sequence
  source: /note="Description of Artificial Sequence: Synthetic scFv sequence"
EVQLVQSGAEVKKPGATVKISCKASGYTFTDYYMHWVQQAPGKGLEWMGYFNPYNDYTRYAEKFQGRVTITADTSTDTAYMELSSLRSEDTAVYYCARSDGYYDAMDYWGQGTTVTVSSGGGGSGGGGSGGGGSDIQMTQSPSAMSASVGDRVTITCRASKSISKYLAWFQQKPGKVPKLRIHSGSTLQSGVPSRFSGSGSGTEFTLTISSLQPEDFATYYCQQHIEYPWTFGQGTKVEIKRAS

SEQ ID NO: 898 - protein, 244 aa, Artificial Sequence
  source: /note="Description of Artificial Sequence: Synthetic scFv sequence"
QVQLVQSGAEVKKPGASVKVSCKASGYTFTDYYMHWVRQAPGQGLEWMGYFNPYNDYTRYAQKFQGRVTMTRDTSISTAYMELSSLRSDDTAVYYCARSDGYYDAMDYWGQGTTVTVSSGGGGSGGGGSGGGGSDIQMTQSPSAMSASVGDRVTITCRASKSISKYLAWFQQKPGKVPKLRIHSGSTLQSGVPSRFSGSGSGTEFTLTISSLQPEDFATYYCQQHIEYPWTFGQGTKVEIKRAS

SEQ ID NO: 899 - protein, 261 aa, Artificial Sequence
  source: /note="Description of Artificial Sequence: Synthetic scFv sequence"
MAQVKLQQSGPELVKPGASVKMSCKASGYTFTSYVMHWVKQSNGKSLEWIGTIDPYYGGTSYNQKFKGKATLTVDKSSTTAYIQLKSLTSEDSAVYYCARWDGYYGGFSYWGQGTMVTVSSGGGGSGGGGSGGGGSDIELTQSPAIMSATLGEKVTMSCRASSNVKYMYWYQQKSGASPKLWIYYTSNLASGVPARFSGSGSGTSYSLTISSVEAEDAATYYCQQFTSSPYTFGSGTKLEIKRAAAGAPVPYPDPLEPRAA

SEQ ID NO: 900 - protein, 265 aa, Artificial Sequence
  source: /note="Description of Artificial Sequence: Synthetic scFv sequence"
MAQVQLQESGPGLVKPSQSLSLTCSVTGYSITSNYWGWIRKFPGNKMEWMGYISYSGSTSYNPSLKSRISITRDTSKNQLFLQLNSVTTEDTATYYCARYSLFNYGRRDYVMDAWGQGTTVTVSSGGGGSGGGGSGGGGSDIELTQSPATMAASPGEKVTITCRASSTVSYMHWFQQKPGASPKPWIYDTSKLASGVPDRFSGSGSGTDFTLTIDPVQADDIATYYCQQSKDDPRTFGGGTKLELKRRPQVRRCRIRIRWNRVPH

SEQ ID NO: 901 - protein, 260 aa, Artificial Sequence
  source: /note="Description of Artificial Sequence: Synthetic scFv sequence"
DIQLTQSPSSLSASVGDRVTITCSASQDISNYLNWYQQKPGKAPKVLIYFTSSLHSGVPSRFSGSGSGTDFTLTISSLQPEDFATYYCQQYSTVPWTFGQGTKVEIKRGSTSGSGKPGSGEGSTKGEVQLVESGGGLVQPGGSLRLSCAASGYDFTHYGMNWVRQAPGKGLEWVGWINTYTGEPTYAADFKRRFTFSLDTSKSTAYLQMNSLRAEDTAVYYCAKYPYYYGTSHWYFDVWGQGTLVTVSSGGGGSGGGGSC

SEQ ID NO: 902 - protein, 251 aa, Artificial Sequence
  source: /note="Description of Artificial Sequence: Synthetic scFv sequence"
QSVLTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGYVFGTGTKVTVLGSRGGGGSGGGGSGGGGSLEMAQVQLVQSGAEVKKPGSSVKVSCKASGGTFSSYAISWVRQAPGQGLEWMGGIIPIFGKGNYPQKFQGRVTITADESTGTAYMELSSLRSEDTAVYYCARHIPTFSFDYWGQGTLVTVSS

SEQ ID NO: 903 - protein, 257 aa, Artificial Sequence
  source: /note="Description of Artificial Sequence: Synthetic scFv sequence"
QIVLSQSPAILSASPGEKVTMTCRASSSVSYIHWFQQKPGSSPKPWIYATSNLASGVPVRFSGSGSGTSYSLTISRVEAEDAATYYCQQWTSNPPTFGGGTKLEIKRGSTSGSGKPGSGEGSTKGQVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSAGGGGSGGGGSC

SEQ ID NO: 904 - protein, 244 aa, Artificial Sequence
  source: /note="Description of Artificial Sequence: Synthetic scFv sequence"
DIKMTQSPSSMYASLGERVTITCKASPDINSYLSWFQQKPGKSPKTLIYRANRLVDGVPSRFSGGGSGQDYSLTINSLEYEDMGIYYCLQYDEFPYTFGGGTKLEMKGSTSGSGKPGSGEGSTKGEVKLVESGGGLVKPGGSLKLSCAASGFTFSSYAMSWVRQIPEKRLEWVASISRGGTTYYPDSVKGRFTISRDNVRNILYLQMSSLRSEDTAMYYCGRYDYDGYYAMDYWGQGTSVTVSS

SEQ ID NO: 905 - protein, 269 aa, Artificial Sequence
  source: /note="Description of Artificial Sequence: Synthetic scFv sequence"
EFGSATMGWSCIILFLVATATGVHSDIKMTQSPSSMYASLGERVTITCKASPDINSYLSWFQQKPGKSPKTLIYRANRLVDGVPSRFSGGGSGQDYSLTINSLEYEDMGIYYCLQYDEFPYTFGGGTKLEMKGSTSGSGKPGSGEGSTKGEVKLVESGGGLVKPGGSLKLSCAASGFTFSSYAMSWVRQIPEKRLEWVASISRGGTTYYPDSVKGRFTISRDNVRNILYLQMSSLRSEDTAMYYCGRYDYDGYYAMDYWGQGTSVTVSS

SEQ ID NO: 906 - protein, 229 aa, Artificial Sequence
  source: /note="Description of Artificial Sequence: Synthetic scFv sequence"
EVQLVESGGGLVKPGGSLRLSCAASGFTFSNAWMSWVRQAPGKGLEWVGRIKSKTDGGTTDYAAPVKGRFTISRDDSKNTLYLQMNSLKTEDTAVYYCARDFGRWSYYFDYWSQGTLVTVSSNIQMTQSPSSLSASVGDRVTITCRASQSINKWLAWYQQKPGKAPKLLIHDASTLESGVPSRFSGSGSGTEFTLTISSLHPDDSATYYCQQLKSPPAQFGEGTKLEIK

SEQ ID NO: 907 - protein, 229 aa, Artificial Sequence
  source: /note="Description of Artificial Sequence: Synthetic scFv sequence"
EVQLVESGGGLVKPGGSLRLSCAASGFTFSNAWMSWVRQAPGKGLEWVGRIKSKTDGGTTDYAAPVKGRFTISRDDSKNTLYLQMNSLKTEDTAVYYCARDFGRWSYYFDYWSQGTLVTVSSNIQMTQSPSSLSASVGDRVTITCRASQSINKWLAWYQQKPGKAPKLLIHDASTLESGVPSRFSGSGSGTEFTLTISSLHPDDSATYYCQQLKSRPLSFGEGTKLEIK

SEQ ID NO: 908 - protein, 232 aa, Artificial Sequence
  source: /note="Description of Artificial Sequence: Synthetic scFv sequence"
EVQLVESGGGLVKPGGSLRLSCAASGFTFSNAWMSWVRQAPGKGLEWVGRIKSKTDGGTTDYAAPVKGRFTISRDDSKNTLYLQMNSLKTEDTAVYYCARDFGRWSYYFDYWSQGTLVTVSSQSVLTQPSSVSGTPGQRVTISCSGSSSNIGSNYVYWYQQLPGTAPKLLIYRNNQRPSGVPDRFSGSKSGTSASLGHQWAPGPRMRLIITAAWDDSLSGVVFGGGTKLTVL

SEQ ID NO: 909 - protein, 232 aa, Artificial Sequence
  source: /note="Description of Artificial Sequence: Synthetic scFv sequence"
EVQLVESGGGLVKPGGSLRLSCAASGFTFSNAWMSWVRQAPGKGLEWVGRIKSKTDGGTTDYAAPVKGRFTISRDDSKNTLYLQMNSLRTEDTAVYYCARDFGRWSYYFDYWSQGTLVTVSSQPVLTQPHSVSESPGKTVTISCTRSSGNIASNFVQWYQRRPDGATTNVIYEDTQRPSGVSGRFSGSIDRSSNSASLTISGLRAEDEADYYCQSYDGRNLMFGGGTKVTVL

SEQ ID NO: 910 - protein, 234 aa, Artificial Sequence
  source: /note="Description of Artificial Sequence: Synthetic scFv sequence"
  MOD_RES (194)..(194): Any amino acid
EVQLVESGGGLVKPGRSLRLSCTASGFTFGDYAMSWFRQAPGKGLEWVGFIRSKAYGGTTEYAASVKGRFTISRDDSKSIAYLQMNSLKTEDTAVYYCAKDFEVREAHLSYFDYWGQGTLVTVSSQSVLTQPPSVSVAPGQTARITCGGNRIGTKAVHWYQQKSGQAPVLVVRDDTDRPSGSLRDSLAPTLGTXAAATLTISGVEAGDEADYYQVWDSSSDHRVFGGGTKLTVL

SEQ ID NO: 911 - protein, 229 aa, Artificial Sequence
  source: /note="Description of Artificial Sequence: Synthetic scFv sequence"
EVQLVESGGGLVQPGRSLRLSCTASGFTFGDYAMSWVRQAPGKGLEWVSSISGSGRSTDHADYVKGRFTISRDNSKNTVYLQMNRLRAEDTAVYYCAKVSNYEYYFDYWAQGTLVTVSSQPVLTQPHSVSESPGKTVTISCTRSSGSIASNYVQWYQQRPGSAPTTVIYEDNQRPSGVPDRFSGSIDSSSNSASLTISGLKTEDEADYYCQSYDSSNHVFGTGTKLTVL

SEQ ID NO: 912 - protein, 229 aa, Artificial Sequence
  source: /note="Description of Artificial Sequence: Synthetic scFv sequence"
EVQLVESGGGLVQPGRSLRLSCTASGFTFGDYAMSWVRQAPGKGLEWVSSISGSGRSTDHADYVKGRFTISRDNSKNTVYLQMNRLRAEDTAVYYCAKVSNYEYYFDYWAQGTLVTVSSQSVLTQPPSVPGTPGQRVTITCSGSRFNIGSNTVNWYQQLPGTAPKLLIYSNNQRPSGVPDRFSGSKSGTSASLAISGLQSEDEADYYCAAWDDSLNGYVFGTGTKLTVL

SEQ ID NO: 913 - protein, 227 aa, Artificial Sequence
  source: /note="Description of Artificial Sequence: Synthetic scFv sequence"
EVQLVESGGGLVQPGRSLRLSCTASGFTFGDYAMSWVRQAPGKGLEWVSSISGSGRSTDHADYVKGRFTISRDNSKNTVYLQMNRLRAEDTAVYYCAKVSNYEYYFDYWAQGTLVTVSSQSVLTQPPSVSVAPGQTARITCGGNNIGSTSVHWFQQKPGQAPVLVVYDDSDRPSGIPERFSGSNSGNTATLTISRVEAGDEADYYCQVWDNDSDHRVFGGGTKLTVL

SEQ ID NO: 914 - protein, 265 aa, Artificial Sequence
  source: /note="Description of Artificial Sequence: Synthetic scFv sequence"
MALPVTALLLPLALLLHAARPQVQLQQSGAELVRPGASVTLSCKASGYTFSDYEMHWVIQTPVHGLEWIGAIDPETGGTAYNQKFKGKAILTADKSSSTAYMELRSLTSEDSAVYYCTGYYDYDSFTYWGQGTLVTVSAGGGGSGGGGSGGGGSDIVMTQSQKIMSTTVGDRVSITCKASQNVDAAVAWYQQKPGQSPKLLIYSASNRYTGVPDRFTGSGSGTDFTLTISNMQSEDLADYFCQQYDIYPYTFGGGTKLEIKRSDP

SEQ ID NO: 915 - protein, 247 aa, Artificial Sequence
  source: /note="Description of Artificial Sequence: Synthetic scFv sequence"
QEQLVESGGRLVTPGGSLTLSCKASGFDFSAYYMSWVRQAPGKGLEWIATIYPSSGKTYYATWVNGRFTISSDNAQNTVDLQMNSLTAADRATYFCARDSYADDGALFNIWGPGTLVTISSGGGGSGGGGSGGGGSELVLTQSPSVSAALGSPAKITCTLSSAHKTDTIDWYQQLQGEAPRYLMQVQSDGSYTKRPGVPDRFSGSSSGADRYLIIPSVQADDEADYYCGADYIGGYVFGGGTQLTVT

SEQ ID NO: 916 - protein, 234 aa, Artificial Sequence
  source: /note="Description of Artificial Sequence: Synthetic scFv sequence"
  MOD_RES (187)..(187): Any amino acid
  MOD_RES (209)..(209): Any amino acid
QITLKESGGGLVKPGGSLRLSCAASGFTFSNAWMSWVRQAPGKGLEWVGRIKSKTDGGTTDYAAPVKGRFTISRDDSKNTLYLQMNSLKTEDTAVYYCARDFGRWSYYFDYWSQGTLVTVSSQSVLTQPPSVSVAPGQTARITCGGNNIGTKSVHWYQQKPGQAPVLVLYDESDRPSGIPERFSGSXAASGNTATLTISRVEAGDEADXAALLQVWDSSSDHYVFGSGTKLTVL

SEQ ID NO: 917 - protein, 242 aa, Artificial Sequence
  source: /note="Description of Artificial Sequence: Synthetic scFv sequence"
  MOD_RES (187)..(187): Any amino acid
  MOD_RES (209)..(209): Any amino acid
  MOD_RES (218)..(218): Any amino acid
  MOD_RES (221)..(221): Any amino acid
  MOD_RES (224)..(224): Any amino acid
  MOD_RES (227)..(227): Any amino acid
QITLKESGGGLVKPGGSLRLSCAASGFTFSNAWMSWVRQAPGKGLEWVGRIKSKTDGGTTDYAAPVKGRFTISRDDSKNTLYLQMNSLKTEDTAVYYCARDFGRWSYYFDYWSQGTLVTVSSQSVLTQPPSVSVAPGQTARITCGGNNIGTKSVHWYQQKPGQAPVLVLYDESDRPSGIPERFSGSXAASGNTATLTISRVEAGDEADXAALLSGVGXAAXAAXAAXAASLCFGSGTKLTVL

SEQ ID NO: 918 - protein, 232 aa, Artificial Sequence
  source: /note="Description of Artificial Sequence: Synthetic scFv sequence"
  MOD_RES (208)..(208): Any amino acid
  MOD_RES (211)..(211): Any amino acid
QITLKESGGGLVKPGGSLRLSCAASGFTFSNAWMSWVRQAPGKGLEWVGRIRSKTDGGTTDYAALVKGRFTISRDDSENTLYLQMNSLKTEDTAVYYCARDFGRWSYYFDYWSQGTLVTVSSSYELTQPPSVSVSPGQTASITCSGDKLGDKYACWYQQKPGQSPVLVIYQDSKRPSGIPERFSGSNSGNTATLTISGTQAMDEADYXAAXAAQAWDSSTVVFGGGTKLTVL

SEQ ID NO: 919 - protein, 234 aa, Artificial Sequence
  source: /note="Description of Artificial Sequence: Synthetic scFv sequence"
  MOD_RES (208)..(208): Any amino acid
  MOD_RES (211)..(211): Any amino acid
  MOD_RES (214)..(214): Any amino acid
QITLKESGGGLVKPGGSLRLSCAASGFTFSNAWMSWVRQAPGKGLEWVGRIRSKTDGGTTDYAALVKGRFTISRDDSENTLYLQMNSLKTEDTAVYYCARDFGRWSYYFDYWSQGTLVTVSSSYELTQPPSVSVSPGQTASITCSGDKLGDKYACWYQQKPGQSPVLVIYQDSKRPSGIPERFSGSNSGNTATLTISGTQAMDEADYXAAXAAXAAAWDSSTVVFGGGTKLTVL

SEQ ID NO: 920 - protein, 228 aa, Artificial Sequence
  source: /note="Description of Artificial Sequence: Synthetic scFv sequence"
QVQLVESGGGLVKPGGSLRLSCAASGFTFSNAWMSWVRQAPGKGLEWVGRIKSKTDGGTTDYAAPVKGRFTISRDDSKNSLYLQMNSLKTEDTAVYYCARDFGRWSYYFDYWGQGTLVTVSSVLTQPPSVSVAPGKTARITCGGNNLGSKNVHWYQQKPGQAPVLVIYDDDNRPSGIPERFSGSNSGNTATLTISRVEAGDEADYYCQVWDSSSRHVVFGGGTKLTVL

SEQ ID NO: 921 - protein, 234 aa, Artificial Sequence
  source: /note="Description of Artificial Sequence: Synthetic scFv sequence"
  MOD_RES (194)..(194): Any amino acid
QVQLVESGGGLVKPGRSLRLSCTASGFTFGDYAMSWFRQAPGKGLEWVGFIRSKAYGGTTEYAASVKGRFTISRDDSKSIAYLQMNSLKTEDTAVYYCAKDFEVREAHLSYFDYWGQGTLVTVSSQSVLTQPPSVSVAPGQTARITCGGNRIGTKAVHWYQQKSGQAPVLVVRDDTDRPSGSLRDSLAPTLGTXAAATLTISGVEAGDEADYYQVWDSSSDHRVFGGGTKLTVL

SEQ ID NO: 922 - protein, 210 aa, Artificial Sequence
  source: /note="Description of Artificial Sequence: Synthetic scFv sequence"
  MOD_RES (208)..(208): Any amino acid
QVTLKESGGGLVKPGGSLRLSCAASGFTFQRLDEWVRQAPGKGLEWVGRIKSKTDGGTTDYAAPVKGRFTISRDDSKNTLYLQMNSLKTEDTAVYYCARDFGRWSYYFDYWSQGTLVTVSSQSALTQDPAVSVALGTDSQDHMPRRQPQKTIMQWYQQKPGQAPALVIYGKNDRPSGIPDRFSGSTSGNTASLTITGAQAEDEADYYXAA

SEQ ID NO: 923 - protein, 229 aa, Artificial Sequence
  source: /note="Description of Artificial Sequence: Synthetic scFv sequence"
QVTLKESGGGLVKPGGSLRLSCAASGFTFSNAWMSWVRQAPGKGLEWVGRIKSKTDGGTTDYAAPVKGRFTISRDDSKNTLYLQMNSLKTEDTAVYYCARDFGRWSYYFDYWSQGTLVTVSSNIQMTQSPSSLSASVGDRVTITCRASQSINKWLAWYQQKPGKAPKLLIHDASTLESGVPSRFSGSGSGTEFTLTISSLHPDDSATYYCQQLKSPPAQFGEGTKLEIK

SEQ ID NO: 924 - protein, 229 aa, Artificial Sequence
  source: /note="Description of Artificial Sequence: Synthetic scFv sequence"
QVTLKESGGGLVKPGGSLRLSCAASGFTFSNAWMSWVRQAPGKGLEWVGRIKSKTDGGTTDYAAPVKGRFTISRDDSKNTLYLQMNSLKTEDTAVYYCARDFGRWSYYFDYWSQGTLVTVSSNIQMTQSPSSLSASVGDRVTITCRASQSINKWLAWYQQKPGKAPKLLIHDASTLESGVPSRFSGSGSGTEFTLTISSLHPDDSATYYCQQLKSRPLSFGEGTKLEIK

SEQ ID NO: 925 - protein, 232 aa, Artificial Sequence
  source: /note="Description of Artificial Sequence: Synthetic scFv sequence"
QVTLKESGGGLVKPGGSLRLSCAASGFTFSNAWMSWVRQAPGKGLEWVGRIKSKTDGGTTDYAAPVKGRFTISRDDSKNTLYLQMNSLKTEDTAVYYCARDFGRWSYYFDYWSQGTLVTVSSQSVLTQPSSVSGTPGQRVTISCSGSSSNIGSNYVYWYQQLPGTAPKLLIYRNNQRPSGVPDRFSGSKSGTSASLGHQWAPGPRMRLIITAAWDDSLSGVVFGGGTKLTVL

SEQ ID NO: 926 - protein, 232 aa, Artificial Sequence
  source: /note="Description of Artificial Sequence: Synthetic scFv sequence"
QVTLKESGGGLVKPGGSLRLSCAASGFTFSNAWMSWVRQAPGKGLEWVGRIKSKTDGGTTDYAAPVKGRFTISRDDSKNTLYLQMNSLRTEDTAVYYCARDFGRWSYYFDYWSQGTLVTVSSQPVLTQPHSVSESPGKTVTISCTRSSGNIASNFVQWYQRRPDGATTNVIYEDTQRPSGVSGRFSGSIDRSSNSASLTISGLRAEDEADYYCQSYDGRNLMFGGGTKVTVL

SEQ ID NO: 927 - protein, 214 aa, Artificial Sequence
  source: /note="Description of Artificial Sequence: Synthetic scFv sequence"
  MOD_RES (4)..(4): Any amino acid
  MOD_RES (13)..(13): Any amino acid
RSPXAARSLGEAXAAVKPGGSLRLSCAASGFTFSNAWMSGSAQAPGKGLEWVGRIKSKTDGGTTDYAAPVKGRFTISRDDSKNTLYLQMNSLKTEDTAVYYCARDFGRWSYYFDYWSQGTLVTVSSEIVMTQSPSFLSASVGDRVTITCRASQGISSYLAWYQQKPGKAPKLLIYAASTLQSGSHQGFSGSGSGTEFTLTISSLQPEDFATYYC

SEQ ID NO: 928 - protein, 255 aa, Artificial Sequence
  source: /note="Description of Artificial Sequence: Synthetic scFv sequence"
DIQMTQSPSSLSASVGDRVTITCSASSSVSYMNWYQQTPGKAPKRWIYDTSKLASGVPSRFSGSGSGTDYTFTISSLQPEDIATYYCQQWSSNPFTFGQGTKLQITRGSTSGSGKPGSGEGSTKGQVQLVQSGGGVVQPGRSLRLSCKASGYTFTRYTMHWVRQAPGKGLEWIGYINPSRGYTNYNQKVKDRFTISRDNSKNTAFLQMDSLRPEDTGVYFCARYYDDHYSLDYWGQGTPVTVSSGGGGSGGGGSC

SEQ ID NO: 929 - protein, 246 aa, Artificial Sequence
  source: /note="Description of Artificial Sequence: Synthetic scFv sequence"
EVQLVETGGGLVQPGKSLELTCATSGFTFNTAWMHWVRQSPDKRLEWIARIKDTSNNYATDYVESMKGRFTISRDDSKGSVNLQMNSLKEEDTATYYCTTDFYDGTYYWNYWGQGVMVTVSSGGGGSGGGGSGGGGSSYELIQPPSAAVTLGNTVSLTCVGDELPKRYAYWYQQKPDQSIVRVIYEDSVRPPGISDRFSGSSSGTTATLTIRDAQNEDEADYYCQSTYGDDKLYIFGGGTKLTVLG

SEQ ID NO: 930 - protein, 257 aa, Artificial Sequence
  source: /note="Description of Artificial Sequence: Synthetic scFv sequence"
DIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKRGSTSGSGKPGSGEGSTKGEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSGGGGSGGGGSC

SEQ ID NO: 931 - protein, 246 aa, Artificial Sequence
  source: /note="Description of Artificial Sequence: Synthetic scFv sequence"
EVQLLESGGGAVQPGRSLRLSCAASGFTFSSYAMHWVRQAPGKGLEWVAVISYDGSNKYYADSVKGRFTISRDNSKNTLYLQMNSLRAEDTAVYYCASGYSSSWYLDYWGQGTLVTVSSGGGGSGGGGSGGGASDIQMTQSPSSVSASVGDRVTITCQASQDISNYLNWYQQKPGKAPKLLIYDASNLETGVPSRFSGSGSGTDFTFTISSLQPEDIATYYCQQYDNLPLTFGGGTKVEIKRTAAA

SEQ ID NO: 932 - protein, 246 aa, Artificial Sequence
  source: /note="Description of Artificial Sequence: Synthetic scFv sequence"
EVQLLESGGGVVQPGRSLRLSCAASGFTFSSYAMHWVRQAPGKGLEWVAVISYDGSNKYYADSVKGRFTISRDNSKNTLYLQMNSLRAEDTAVYYCAKGGDTYGFLDNWGQGTMVTVSSGGGGSGGGGSGGGASDIQMTQSPSTLSASVGDRVTITCRASQSISSWLAWYQQKPGKAPKLLIYKASSLESGVPSRFSGSGSGTDFTLTISSLQPEDFATYYCQQFNAYPLTFGGGTKVEIKRTAAA

SEQ ID NO: 933 - protein, 249 aa, Artificial Sequence
  source: /note="Description of Artificial Sequence: Synthetic scFv sequence"
EVQLLESGGGVVQPGRSLRLSCAASGFTFSSYGMHWVRQAPGKGLEWVAVISYDGSNKYYADSVKGRFTISRDNSKNTLYLQMNSLRAEDTAVYYCAKDDGAMRYWGQGTMVTVSSGGGGSGGGGSGGGASDIQMTQSPDSLAVSLGERATINCKSSQSVLYSSNNKNYLAWYQQKPGQPPKLLIYWASTRESGVPDRFSGSGSGTDFTLTISSLQAEDVAVYYCQQYYDSPYTFGQGTKVDIKRTAAA

SEQ ID NO: 934 - protein, 247 aa, Artificial Sequence
  source: /note="Description of Artificial Sequence: Synthetic scFv sequence"
  MOD_RES (101)..(101): Any amino acid
EVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARGYXASSWSQGLWGQGTLVTVSSGGGGSGGGGSGGGASDIQMTQSPSSLSASVRDRVTITCQASQDISNYLNWYQQKPGKAPKLLIYDASNLETGVPSRFSGSGSGTDFTFTISSLQPEDIATYYCQQYDNLPPTFGGGTKVEIKRTAAA

SEQ ID NO: 935 - protein, 252 aa, Artificial Sequence
  source: /note="Description of Artificial Sequence: Synthetic scFv sequence"
EVRLQQSGPDLIKPGASVKMSCKASGYTFTGYVMHWVKQRPGQGLEWIGFINPYNDDIQSNERFRGKATLTSDKSSTTAYMELSSLTSEDSAVYYCARGAGYNFDGAYRFFDFWGQGTTLTVSSGGGGSGGGGSGGGGSDVVMTQSPLSLPVSLGDQASISCRSSQRLVHSNGNTYLHWYLQKPGQSPKLLIYRVSNRFPGVPDRFSGSGSGTDFTLKISRVEAEDLGIYFCSQSTHVPYTFGGGTKLEIKR

SEQ ID NO: 936 - protein, 245 aa, Artificial Sequence
  source: /note="Description of Artificial Sequence: Synthetic scFv sequence"
QVQLVESGAEVKKPGASVKVSCKASGYTFTGYYMHWVRQAPGQGLEWMGRINPNSGGTNYAQKFQGRVTMTRDTSISTAYMELSRLRSDDTAVYYCASGGAGWNWGQGTMVTVSSGGGGSGGGGSGGGASNFMLTQPHSVSESPGKTATISCTRSSGSIASNYVQWYQQRPGSAPTTVIYEDNQRPFGVPDRFSGSIDSSSNSASLTISGLKTEDEADYYCQSHDSSNVVFGGGTQLTVLGQPAA

SEQ ID NO: 937 - protein, 246 aa, Artificial Sequence
  source: /note="Description of Artificial Sequence: Synthetic scFv sequence"
QVQLVESGGGLVQPGRSLRLSCAASGFTFSSYAMHWVRQAPGKGLEWVAVISYDGSSKYYADSVKGRFTISRDNSKNTLYLQMNSLRAEDTAVYYCAKGGGSFGAFDIWGQGTLVTVSSGGGGSGGGGSGGGASDIQMTQSPSSLSASVGDRVTITCRASQSISRYLNWYQQKPGKAPNLLIYAASSLQSGVPSRFSGSGSGTDFTLTISSLQPEDFATYYCQQYNSYPLTFGGGTKLEIKRTAAA

SEQ ID NO: 938 - protein, 244 aa, Artificial Sequence
  source: /note="Description of Artificial Sequence: Synthetic scFv sequence"
QVQLVESGGGVVQPGRPLRLSCAASGFTFSSYAMHWVRQAPGKGLEWVAVISYDGSNKYYADSVKGRFTISRDNSKNTLYLQMNSLRAEDTAVYYCARAGYSYADYWGQGTMVTVSSGGGGSGGGGSGGGASDIQMTQSPSSLSASVGDRVTITCRASQGIRNDLGWYQQKPGKAPKRLIYAASSLQSGVPSRFSGSGSGTEFTLTISSLQPEDFATYYCLQHNSYPLTFGGGTKVDIKRTAAA

SEQ ID NO: 939 - protein, 244 aa, Artificial Sequence
  source: /note="Description of Artificial Sequence: Synthetic scFv sequence"
QVQLVESGGGVVQPGRSLRLSCAAPGFTFSSYGMHWVRQAPGKGLEWVAVISYDGSNKYYADSVKGRFTISRDNSKNTLYLQMNSLRAEDTAVYYCARNKQYGMDVWGQGTLVTVSSGGGGSGGGGSGGGASDIVMTQSPATLSLAPGERATLSCRASQSVGSNLAWYQQKPGQAPSLLIYDASTRATGIPARFSGSGSGTDFTLTISSLQSEDIAVYYCQQYHRWPLTFGGGTKVEIKRTAAA

SEQ ID NO: 940 - protein, 247 aa, Artificial Sequence
  source: /note="Description of Artificial Sequence: Synthetic scFv sequence"
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARAHNSSSWSFDYWGQGTLVTVSSGGGGSGGGGSGGGASDIQMTQSPSSLSASVGDRVTITCRASQSISSYLNWYQQKPGKAPKLLIYDASNLETGVPSRFSGSGSGTDFTFTISSLQPEDIATYYCQQYDNLPLTFGGGTKVDIKRTAAA

SEQ ID NO: 941 - protein, 251 aa, Artificial Sequence
  source: /note="Description of Artificial Sequence: Synthetic scFv sequence"
QVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCAKDLGGSGGAFDIWGQGTLVTVSSGGGGSGGGGSGGGASDIVMTQTPHSLSVTPGQPASISCKSSQSLLYSDGKTYLYWYLQKPGQPPQLLIYEVSNRFSGVPDRFSGSGSGTDFTLKISRVEAEDVGVYYCMQSIQLYTFGQGTKVDIKRTAAA

SEQ ID NO: 942 - protein, 247 aa, Artificial Sequence
  source: /note="Description of Artificial Sequence: Synthetic scFv sequence"
EVQLVESGAEVKKPGASVKVSCKASGYTFTGYYMHWVRQAPGQGLEWMGRINPNSGGTNYAQKFQGRVTMTRDTSISTAYMELSSLRSEDTAVYYCARFGERYAFDIWGQGTLVTVSSGGGGSGGGGSGGGASQSELTQPPSASGSPGQSVTISCTGTSTDVGAFHFVSWYQHTPGKAPKLLISEVRKRASGVPDRFSGSRSGNTASLTVSGLQSEDEADYFCSAYTGSNYVFGSGTKLTVLGQPAA

SEQ ID NO: 943 - protein, 249 aa, Artificial Sequence
  source: /note="Description of Artificial Sequence: Synthetic scFv sequence"
EVQLVESGGGVVQPGGSLRLSCAASGFTFSSYAMSWVRQAPGKGLEWVSAISGSGGSTYYADSVKGRFSISRDNSKNTLYLQMNSLRAEDTAVYYCARTRSSGAFDIWGQGTLVTVSSGGGGSGGGGSGGGASNFMLTQPHSVSESPGKTVTISCTRSSGSIASKYVQWYQQRPGSSPTTVIYEDNQRPSGVPDRFSGSIDTSSNSASLTISGLRTEDEADYYCHSYDSNNHSVFGGGTKVTVLGQPAA

SEQ ID NO: 944 - protein, 251 aa, Artificial Sequence
  source: /note="Description of Artificial Sequence: Synthetic scFv sequence"
EVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARGGFTVPGGAFDIWGQGTLVTVSSGGGGSGGGGSGGGASNFMLTQPHSVSDSPGKTVTISCTRSSGRIGSNFVQWYQQRPGSSPTTVIYEDDQRPSGVPARFSGSIDSSSNSASLTISGLTTADEAGYYCQSYDASNVIFGGGTKLTVLGQPAA

SEQ ID NO: 945 - protein, 248 aa, Artificial Sequence
  source: /note="Description of Artificial Sequence: Synthetic scFv sequence"
EVQLVQSGAEVKKPGASVKVSCKASGYTFTGYYMHWVRQAPGQGLEWMGWINPNSGGTNYAQKFQGRVTMTRDTSISTAYMELSSLRSEDTAVYYCARDTGPIDYWGQGTMVTVSSGGGGSGGGGSGGGASDIVMTQTPLSLSVTPGQPASISCKSSQSLLHSDGKTYLYWYLQKPGQPPQLLVYEVSNRFSGVPDKFSGSGSGTDFTLKISRVEAEDVGVYYCMQGIQLPPTFGGGTKVDIKRTAAA

SEQ ID NO: 946 - protein, 249 aa, Artificial Sequence
  source: /note="Description of Artificial Sequence: Synthetic scFv sequence"
EVQLVQSGAEVKKPGSSVKVSCEASGYTFTSYAISWVRQAPGQGLEWMGWMNPNSGNTGYAQKFQGRVTMTRNTSISTAYMELSSLRSEDTAVYYCARVSSYYGMDVWGQGTLVTVSSGGGGSGGGGSGGGASNFMLTQPLSVSESPGKTVTISCTRSSGSIASNYVQWYQQRPGSAPTTVIYEDNQRPSGVPDRFSGSIDSSSNSASLTISGLKTEDEADYYCQSYNSSNHWVFGGGTKVTVLGQPAA

SEQ ID NO: 947 - protein, 249 aa, Artificial Sequence
  source: /note="Description of Artificial Sequence: Synthetic scFv sequence"
EVQLVQSGAEVKKPGSSVKVSCKASGGTFSSYAISWVRQAPGQGLEWMGIINPSGGSTSYAQKFQGRVTMTRDTSTSIVYMELSSLRSEDTAVYYCARGVWNSGSYLGFDYWGQGTLVTVSSGGGGSGGGGSGGGASDIQMTQSPSSLSASVGDRVTITCQASQDISNYLNWYQQKPGKAPKLLIYAASSLQSGVPSRFSGSGSGTDFTLTISSLQPEDFATYYCQQSYSTPLTFGGGTKLEIKRTAAA

SEQ ID NO: 948 - protein, 252 aa, Artificial Sequence
  source: /note="Description of Artificial Sequence: Synthetic scFv sequence"
QMQLVQSGAEVKKPGASVKVSCKASGYTFASYYMHWVRQAPGQGLEWMGIINPSGGSTSYAQKFQGRVTMTRDTSTSTVYMELSRLRSDDTAVYYCASNRGGSYKSVGMDVWGQGTTVTVSSGGGGSGGGGSGGGASNFMLTQPQSVSESPGKTVTISCTRSSGNFASKYVQWYQQRPGSSPTTVIYENYQRPSGVPDRFSGSIDSSSNSATLTISGLKTEDEADYYCQSYDEVSVVFGGGTQLTVLGQPAA

SEQ ID NO: 949 - protein, 252 aa, Artificial Sequence
  source: /note="Description of Artificial Sequence: Synthetic scFv sequence"
QVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCARDQWLANYYYYGMDVWGQGTLVTVSSGGGGSGGGGSGGGASSYELTQPLSVSVALGQTARITCGGNNIGSKNVHWYQQKPGQAPVLVIYRDNNRPSGIPERFSGSNSGNTATLTISKAQAGDEADYYCQVWDSNSWVFGGGTKLTVLGQPAA

SEQ ID NO: 950 - protein, 246 aa, Artificial Sequence
  source: /note="Description of Artificial Sequence: Synthetic scFv sequence"
QVQLVESGAEVKKPGASVKVSCKASGYTFTGYYMHWVRQAPGQGLEWMGRINPNSGGTNYAQKFQGRVTMTRDTSISTAYMELSRLRSDDTAVYYCASPRGRGSAFDIWGQGTLVTVSSGGGGSGGGGSGGGASSYELTQPPSVSVSPGQTATISCSGDQLGGKYGHWYQKKPGQSPVLVLYQDRKRPAGIPERFSGSSSGNTITLTISGTQAVDEADYYCQAWDTNLGGVFGGGTKVTVLGQPAA

SEQ ID NO: 951 - protein, 249 aa, Artificial Sequence
  source: /note="Description of Artificial Sequence: Synthetic scFv sequence"
QVQLVESGGGLVKPGGSLRLSCAASGFTFSDYYMSWIRQAPGKGLEWVSYISSSGSTIYYADSVEGRFTISRDNAKNSLYLQMNSLRTEDTAVYYCARARVGGMDVWGQGTMVTVSSGGGGSGGGGSGGGASNFMLTQPHSVSESPGKTVTISCTRSSGSIASNYVQWYQQRPGSSPTTVIYEDNQRPSGVPDRFSGSIDSSSNSASLTISGLKTEDEADYYCQSFDADNLHVVFGGGTKLTVLGQPAA

SEQ ID NO: 952 - protein, 240 aa, Artificial Sequence
  source: /note="Description of Artificial Sequence: Synthetic scFv sequence"
QVTLESGPGILPSQTLSLTCSFSGFSLSTSGMGVGWIRQPSGKGLEWLAHIWWDDDKYYNPSLKSQLTISDTSRNQVFLKITSVDTADTATYYCSRRPRGTMDAMDYWGQGTSVTVSSGGGGSGGGGSGGGGSDIVMTQAASSLSASLGDRVTISCRASQDISKYLNWYQQKPDGTVKLLIYYTSRLHSGVPSRFSGSGSGTDYSLTIRNLEQEDIATYFCQQVYTLPWTFGGGTKLEIK

SEQ ID NO: 953 - protein, 245 aa, Artificial Sequence
  source: /note="Description of Artificial Sequence: Synthetic scFv sequence"
QVTLKESGPGILKPSQTLSLTCSFSGFSLNTSGMGVGWIRQPSGKGLEWLAHIWWDDDKYYNPSLKSQLTISKDTSRNQVFLKITSVDTADSATYYCARRASHVSTVDSFDFWGQGTTLTVSSGGGGSGGGGSGGGGSDIQMTQTTSSLSASLGDRVTISCRASQDISNYLNWFQQKPDGTVKLLIYYTSRLHSGVPSKFSGSGSGTDYSLTISNLEQEDIATYFCQQGYTLPWTFGGGTKLEIK

SEQ ID NO: 954 - protein, 242 aa, Artificial Sequence
  source: /note="Description of Artificial Sequence: Synthetic scFv sequence"
QVTLKESGPGILKPSQTLSLTCSFSGFSLNTSGMGVGWIRQPSGKGLEWLAHIWWDDDKYYNPSLKSQLTISKDTSRNQVFLKITSVDTADSATYYCARRASHVSTVDSFDFWGQGTTLTVSSGGGGSGGGGSGGGGSDIQMTQTTSSLSASLGDRVTISCRASQDISNYLNWFQQPDGTVLLIYYTSRLHSGVPSFSGSGSGTDYSLTISNLEQEDIATYFCQQGYTLPWTFGGGTKLEIK

SEQ ID NO: 955 - protein, 243 aa, Artificial Sequence
  source: /note="Description of Artificial Sequence: Synthetic scFv sequence"
QVTLKESGPGILKPSQTLSLTCSFSGFSLSTSGMGVGWIRQPSGKGLEWLAHIWWDDDKYYNPSLKSQLTISKDTSRNQVFLKITSVDTADTATYYCSRRPRGTMDAMDYWGQGTSVTVSSGGGGSGGGGSGGGGSDIVMTQAASSLSASLGDRVTISCRASQDISKYLNWYQQKPDGTVKLLIYYTSRLHSGVPSRFSGSGSGTDYSLTIRNLEQEDIATYFCQQVYTLPWTFGGGTKLEIK

SEQ ID NO: 956 - protein, 247 aa, Artificial Sequence
  source: /note="Description of Artificial Sequence: Synthetic scFv sequence"
EVQLLESGGGLVQPGGSLRLSCAASGFTFSDYYMSWVRQAPGKGLEWVSAIYSGGGSIYYADSVKGRFTISRDNSKNTLYLQMNSLRAEDTAVYYCARDVQWNKAPRFDYWGQGTLVTVSSGGGGSGGGGSGGGGSQSVLTQPPSASGAPGQRVTISCSGSSSNIGSNDVSWYQQLPGTAPKLLIYADSNRPSGVPDRFSGSKSGTSASLAISGLRSEDEADYYCGSWDYSLSGYVFGGGTKLTVLG

SEQ ID NO: 957 - protein, 247 aa, Artificial Sequence
  source: /note="Description of Artificial Sequence: Synthetic scFv sequence"
EVQLLESGGGLVQPGGSLRLSCAASGFTFSGYAMSWVRQAPGKGLEWVSGISHDGGNTYYADSVKGRFTISRDNSKNTLYLQMNSLRAEDTAVYYCARDRRKGPSTEFDYWGQGTLVTVSSGGGGSGGGGSGGGGSQSVLTQPPSLSGTPGQRVTISCTGSSSNIGSNSVSWYQQLPGTAPKLLIYDDNNRPSGVPDRFSGSKSGTSASLAISGLRSEDEADYYCGAWDYSLSAYVFGGGTKLTVLG

SEQ ID NO: 958 - protein, 253 aa, Artificial Sequence
  source: /note="Description of Artificial Sequence: Synthetic scFv sequence"
EVQLLESGGGLVQPGGSLRLSCAASGFTFSGYAMSWVRQAPGKGLEWVSSIYSSSGSKYYADSVKGRFTISRDNSKNTLYLQMNSLRAEDTAVYYCARASSTCTRTWCSYDDAMDVWGQGTLVTVSSGGGGSGGGGSGGGGSQSVLTQPPSASGTPGQRVTISCTGSSSNIGNNAVTWYQQLPGTAPKLLIYDDSHRPSGVPDRFSGSKSGTSASLAISGLRSEDEADYYCGTWDYSLSGYVFGGGTKLTVLG

SEQ ID NO: 959 - protein, 253 aa, Artificial Sequence
  source: /note="Description of Artificial Sequence: Synthetic scFv sequence"
EVQLLESGGGLVQPGGSLRLSCAASGFTFSNYDMSWVRQAPGKGLEWVSGIYPNGGSKYYADSVKGRFTISRDNSKNTLYLQMNSLRAEDTAVYYCARALRQCQRYWCSYADGMDVWGQGTLVTVSSGGGGSGGGGSGGGGSQSVLTQPPSASGTPGQRVTISCTGSSSNIGSNYVSWYQQLPGTAPKLLIYADSQRPSGVPDRFSGSKSGTSASLAISGLRSEDEADYYCGTWDYSLSGYVLGGGTKLTVLG

SEQ ID NO: 960 - protein, 253 aa, Artificial Sequence
  source: /note="Description of Artificial Sequence: Synthetic scFv sequence"
EVQLLESGGGLVQPGGSLRLSCAASGFTFSNYDMSWVRQAPGKGLEWVSLISHGGGNIYYADSVKGRFTISRDNSKNTLYLQMNSLRAEDTAVYYCARVPVMCTNHWCSYANGMDVWGQGTLVTVSSGGGGSGGGGSGGGGSQSVLTQPPSASGTPGQRVIISCSASSSNIGSNAVYWYQQLPGTAPKLLIYSDNQRPSGVPDRFSGSKSGTSASLAISGLRSEDEADYYCGSWDYSLSAYVFGGGTKLTVLG

SEQ ID NO: 961 - protein, 247 aa, Artificial Sequence
  source: /note="Description of Artificial Sequence: Synthetic scFv sequence"
EVQLLESGGGLVQPGGSLRLSCAASGFTFSSYSMSWVRQAPGKGLEWVSGISHGGGNKYYADSVKGRFTISRDNSKNTLYLQMNSLRAEDTAVYYCARDLRANNDTGFDYWGQGTLVTVSSGGGGSGGGGSGGGGTQSVLTQPPSSSGTPGQRVTISCTGSSSNIGSNAVTWYQQLPGTAPKLLIYDDNHRPSGVPDRFSGSKSGTSASLAISGLRSEDEADYYCGAWDYSLNAYVFGGGTKLTVLG

SEQ ID NO: 962 - protein, 247 aa, Artificial Sequence
  source: /note="Description of Artificial Sequence: Synthetic scFv sequence"
EVQLLESGGGLVQTGGSLRLSCAASGFTFSDYAMSWVRQAPGKGLEWVSSIYPGSGSKYYADSVKGRFAISRDNSKNTLYLQMNSLRAEDTAVYYCARDAWFRGHNVFDYWGQGTLVTVSSGGGGSGGGGSGGGGSQSVLTQPPSASGTPGQRVTISCTGSSSNIGSNNVTWYQQLPGTAPKLLIYSDSHRPSGVPDRFSGSKSGTSASLAISGLQSEDEADYYCGSWDYSLSAYVFGGGTKLTVLG

SEQ ID NO: 963 - protein, 253 aa, Artificial Sequence
  source: /note="Description of Artificial Sequence: Synthetic scFv sequence"
EVQLLESGGGLVQTGGSLRLSCAASGFTFSDYAMSWVRQAPGKGLEWVSWIYPGDSSIYYADSVKGRFTISRDNSKNTLYLQMNSLRAEDTAVYYCARLLSIDQAQLHYYYDAMDVWGQGTLVTVSSGGGGSGGGGSGGGGSQSVLTQPPSPSGTPGQRVTISCTGSSSNIGNYYVYWYQQLPGTAPKLLIYANSHRPSGVPDRFSGSKSGTSASLAISGLRSEDEADYYCGSWDDSLSAYVFGGGTKLTVLG

SEQ ID NO: 964 - protein, 251 aa, Artificial Sequence
  source: /note="Description of Artificial Sequence: Synthetic scFv sequence"
AIQMTQSPSSLSASVGDRVTITCRASQSISSYLNWYQQKPGKAPKLLIHAASNLQSGVPSRFSGSGSGTDFTLTISSLQPEDFATYYCQQSYSTPLTFGGGTKVEIKLGSGGSGGGGSGGGGSGGGGSGGSGGEVQLLESGGGLVQPGGSLRLSCAASGFTFSHYEMGWVRQAPGKGLEWVSYISSSGGWTAYADSVKGRFTISRDNSKNTLYLQMNSLRAEDTAVYYCARIGYADAFDIWGQGTTVTVSS

SEQ ID NO: 965 - protein, 248 aa, Artificial Sequence
  source: /note="Description of Artificial Sequence: Synthetic scFv sequence"
EVQLLESGGGLVQPGGSLRLSCAASGFTFSGYIMWWVRQAPGKGLEWVSVISPSGGDTWYADSVKGRFTISRDNSKNTLYLQMNSLRAEDTAVYYCATAGDYWGQGTLVTVSSVGSGGSGGGGSGGGGSGGGGSGGSGGQSELTQPPSASGTPGQRVTISCSGSSSNIGRNPVNWYQHLPGTAPKLLIYGDNQRPSGVPDRFSGSRSGTSASLAISGLQSEDEADYYCAAWDDSLNGVVFGGGTKLTV

SEQ ID NO: 966 - protein, 254 aa, Artificial Sequence
  source: /note="Description of Artificial Sequence: Synthetic scFv sequence"
EVQLLESGGGLVQPGGSLRLSCAASGFTFSKYDMHWVRQAPGKGLEWVSVISPSGGWTSYADSVKGRFTISRDNSKNTLYLQMNSLRAEDTAMYYCARDDYSKGRDAFDIWGQGTLVTVSSVGSGGSGGGGSGGGGSGGGGSGGSGGDIQLTQSPSSLSASVGDRVTITCRASQSISSYLNWYQQKPGKAPKLLIYAASSLQSGVPSRFSGSGSGTDFTLTISSLQPEDFATYYCQQSYSTPYTFGQGTKLEIK

SEQ ID NO: 967 - protein, 252 aa, Artificial Sequence
  source: /note="Description of Artificial Sequence: Synthetic scFv sequence"
EVQLLESGGGLVQPGGSLRLSCAASGFTFSTYDMHWVRQAPGKGLEWVSVISPSGGWTAYADSVKGRFTISRDNSKNTLYLQMNSLRAEDTAVYYCARAAAGYDAFDIWGQGTMVTVSSVGSGGSGGGGSGGGGSGGGGSGGSGGEIVLTQSPSPLSASVGDRVTITCRASHNINKYLNWYQQKPGKAPKLLIFGASSLRSGVPSRFSGSGSGTDFTLTISSLEPEDLATYFCQQTYNTPLTFGGGTKLEIK

SEQ ID NO: 968 - protein, 255 aa, Artificial Sequence
  source: /note="Description of Artificial Sequence: Synthetic scFv sequence"
EVQLLESGGGLVQPGGSLRLSCAASGFTFSWYDMDWVRQAPGKGLEWVSVISPSGGWTAYADSVKGRFTISRDNSKNTLYLQMNSLRAEDTAVYYCARDSSGYYSPDAFDIWGQGTLVTVSSVGSGGSGGGGSGGGGSGGGGSGGSGGNIQMTQSPSSLSASVGDRVTITCRASQSISSYLNWYQQKPGKAPKLLIYDASSLQSGVPLRFSGSGSGTDFTLTISSLQPEDFATYYCQQSYSTPLTFGGGTKVDIK

SEQ ID NO: 969 - protein, 254 aa, Artificial Sequence
  source: /note="Description of Artificial Sequence: Synthetic scFv sequence"
EVQLLESGGGLVQPGGSLRLSCAASGFTFSWYDMVWVRQAPGKGLEWVSVISPSGGWTSYADSVKGRFTISRDNSKNTLYLQMNSLRAEDTAVYYCARDHSGYDSEYFDYWGQGTLVTVSSVGSGGSGGGGSGGGGSGGGGSGGSGGNIQMTQSPSSLSASVGDRVTITCRASQSISSYLNWYQQKPGKAPKLLIYAASSLQSGVPSRFSGSGSGTDFTLTISSLQPEDFATYYCQQSYSTPYTFGQGTKLEIK

SEQ ID NO: 970 - protein, 260 aa, Artificial Sequence
  source: /note="Description of Artificial Sequence: Synthetic scFv sequence"
MDFQVQIFSFLLISASVIMSRGDIQMTQSPSSVSASIGDRVTITCRASQGIDNWLGWYQQKPGKAPKLLIYDASNLDTGVPSRFSGSGSGTYFTLTISSLQAEDFAVYFCQQAKAFPPTFGGGTKVDIKGSTSGSGKPGSGEGSEVQLVQSGGGLVKPGGSLRLSCAASGFTFSSYSMNWVRQAPGKGLEWVSSISSSSSYIYYADSVKGRFTISRDNAKNSLYLQMNSLRAEDTAVYYCARVTDAFDIWGQGTMVTVSS

SEQ ID NO: 971 - protein, 265 aa, Artificial Sequence
  source: /note="Description of Artificial Sequence: Synthetic scFv sequence"
MGWSCIILFLVATATGVHSEVQLVETGGGLVQPGNSLKLSCATSGFIFSTTWMNWIRQTPGKRLEWLAQIEDKSNNYFISYSESVKGRFTISRDDSKSSVYLQMNNLKEEDTAIYYCSWKYRSNYYFDYWGQGVMVTVSSGSTSGSGKPGSGEGSDIVLTQSPALAVSLEQRATISCKTSQNVDYYGISYLHWYQQKPGQQPKLLIYEGSNLASGIPARFSGSGSGTDFTLTIDPVEADDIVTYYCQQSKDYPYTFGAGTKLELK

SEQ ID NO: 972 - protein, 250 aa, Artificial Sequence
  source: /note="Description of Artificial Sequence: Synthetic scFv sequence"
DIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVDIKRSRGGGGSGGGGSGGGGSLEMAQVQLQQSGPGLVKPSQTLSLTCAISGDSVSSNSAAWNWIRQSPSRGLEWLGRTYYGSKWYNDYAVSVKSRITINPDTSKNQFSLQLNSVTPEDTAVYYCARGRLGDAFDIWGQGTMVTVSS

SEQ ID NO: 973 - protein, 246 aa, Artificial Sequence
  source: /note="Description of Artificial Sequence: Synthetic scFv sequence"
DIQMTQSPSTLSASVGDRVTITCRASQNINKWLAWYQQRPGKAPQLLIYKASSLESGVPSRFSGSGSGTEYTLTISSLQPDDFATYYCQQYNSYATFGQGTKVEIKRSRGGGGSGGGGSGGGGSLEMAQVQLVQSGAEVKKPGESLKISCKGSGYNFSNKWIGWVRQLPGRGLEWIAIIYPGYSDITYSPSFQGRVTISADTSINTAYLHWHSLKASDTAMYYCVRHTALAGFDYWGLGTLVTVSS

SEQ ID NO: 974 - protein, 243 aa, Artificial Sequence
  source: /note="Description of Artificial Sequence: Synthetic scFv sequence"
DVQLVQSGAEVKKPGASVKVSCKASGYTFTRYTMHWVRQAPGQGLEWIGYINPSRGYTNYADSVKGRFTITTDKSTSTAYMELSSLRSEDTATYYCARYYDDHYCLDYWGQGTTVTVSSGEGTSTGSGGSGGSGGADDIVLTQSPATLSLSPGERATLSCRASQSVSYMNWYQQKPGKAPKRWIYDTSKVASGVPARFSGSGSGTDYSLTINSLEAEDAATYYCQQWSSNPLTFGGGTKVEIK

SEQ ID NO: 975 - protein, 253 aa, Artificial Sequence
  source: /note="Description of Artificial Sequence: Synthetic scFv sequence"
QAVVTQPPSASGTPGQRVTISCSGSSSNIGSNTVNWYQQVPGTAPKLLIYSNNQRPSGVPDRFSGSKSGTSASLAISGLQSEDEADYYCAAWDDSLNGWVFGGGTKLTVLGSRGGGGSGGGGSGGGGSLEMAQMQLVQSGAEVKEPGESLRISCKGSGYSFTNFWISWVRQMPGKGLEWMGRVDPGYSYSTYSPSFQGHVTISADKSTSTAYLQWNSLKASDTAMYYCARVQYSGYYDWFDPWGQGTLVTVSS

SEQ ID NO: 976 - protein, 251 aa, Artificial Sequence
  source: /note="Description of Artificial Sequence: Synthetic scFv sequence"
QSVLTQPPSVSGAPGQRVTISCTGSSSNIGAGYDVHWYQQLPGTAPKLLIYGNSNRPSGVPDRFSGSKSGTSASLAISGLQSEDEADYYCAAWDDSLNGYVFGTGTKLTVLGSRGGGGSGGGGSGGGGSLEMAEVQLVETGGGLLQPGGSLRLSCAASGFSVSGTYMGWVRQAPGKGLEWVALLYSGGGTYHPASLQGRFIVSRDSSKNMVYLQMNSLKAEDTAVYYCAKGGAGGGHFDSWGQGTLVTVSS

SEQ ID NO: 977 - protein, 249 aa, Artificial Sequence
  source: /note="Description of Artificial Sequence: Synthetic scFv sequence"
QSVVTQPPSVSVAPGKTARITCGRNNIGSKSVHWYQQKPGQAPVLVVYDDSDRPSGIPERFSGSNSGNTATLTISRVEAGDEADYYCQVWDSSSDHVVFGGGTKLTVLGSRGGGGSGGGGSGGSLEMAEVQLVQSGGGVVRPGGSLRLSCAASGFTFDDYGMSWVRQAPGKGLEWVSGINWNGGSTGYADSVRGRFTISRDNAKNSLYLQMNSLRAEDTALYYCARERGYGYHDPHDYWGQGTLVTVSS

SEQ ID NO: 978 - protein, 250 aa, Artificial Sequence
  source: /note="Description of Artificial Sequence: Synthetic scFv sequence"
QTVVTQPPSASGTPGQRVTISCSGSSSNIGSNYVYWYQQLPGTAPKLLIYRSNQRPSGVPDRFSGSKSGTSASLAISGPRSVDEADYYCAAWDDSLNGVVFGGGTKLTVLGSRGGGGSGGGGSGGGSLEMAQVQLVQSGAEVKKPGSSVKVSCKASGGTFSSYAISWVRQAPGQGLEWMGGIIPIFGTANYAQKFQGRVTITADESTSTAYMELSSLRSEDTAVYYCARRIPPYYGMDVWGQGTTVTVSS

SEQ ID NO: 979 - protein, 243 aa, Artificial Sequence
  source: /note="Description of Artificial Sequence: Synthetic scFv sequence"
QLVESGGGLVQPGRSLRLSCTTSGFTFGDYAMIWARQAPGKGLEWVSSISSSSSYIYYADSVKGRFTISRDNAKNSLYLQMNSLRAEDTAVYYCARERYDFWSGMDVWGKGTTVTVSSGGGGSGGGGSGGSAQSALTQPASVSGSPGQSITISCTGTSSDVGSYNLVSWYQQHPGKAPKLMIYEGSKRPSGVSNRFSGSKSGNAASLTISGLQAEDEADYYCQSYDSSLSVVFGGGTKLTVLG

SEQ ID NO: 980 - protein, 258 aa, Artificial Sequence
  source: /note="Description of Artificial Sequence: Synthetic scFv sequence"
SRAAQPAMAQVQLQQSGAELVKPGASVKISCKASGYSFTGYFMNWVKQSHGKSLEWIGRIHPYDGDTFYNQNFKDKATLTVDKSSNTAHMELLSLTSEDFAVYYCTRYDGSRAMDYWGQGTTVTVSSGGGGSGGGGSETGGGGSDIELTQSPASLAVSLGQRAIISCKASQSVSFAGTSLMHWYHQKPGQQPKLLIYRASNLEAGVPTRFSGSGSKTDFTLNIHPVEEEDAATYYCQQSREYPYTFGGGTKLEIKRAA

SEQ ID NO: 981 - protein, 243 aa, Artificial Sequence
  source: /note="Description of Artificial Sequence: Synthetic scFv sequence"
DIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKGSTSGSGKPGSGEGSGEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDVWGQGTLVTVSS

SEQ ID NO: 982 - DNA, 729 bp, Artificial Sequence
  source: /note="Description of Artificial Sequence: Synthetic scFv sequence"
gatatccagatgacccagtccccgagctccctgtccgcctctgtgggcgatagggtcaccatcacctgccgtgccagtcaggatgtgaatactgctgtagcctggtatcaacagaaaccaggaaaagctccgaaactactgatttactcggcatccttcctttattctggagtcccttctcgcttctctggatctagatctgggacggatttcactctgaccatcagcagtctgcagccggaagacttcgcaacttattactgtcagcaacattatactactcctcccacgttcggacagggtaccaaggtggagatcaaagggtctacatctggatctgggaagccgggttctggtgagggttctggtgaggttcagctggtggagtctggcggtggcctggtgcagccagggggctcactccgtttgtcctgtgcagcttctggcttcaacattaaagacacctatatacactgggtgcgtcaggccccgggtaagggcctggaatgggttgcaaggatttatcctacgaatggttatactagatatgccgatagcgtcaagggccgtttcactataagcgcagacacatccaaaaacacagcctacctgcagatgaacagcctgcgtgctgaggacactgccgtctattattgttctagatggggaggggacggcttctatgctatggacgtgtggggtcaaggaaccctggtcaccgtctcctcg

SEQ ID NO: 983 - protein, 120 aa, Homo sapiens
WRRKRKEKQSETSPKEFLTIYEDVKDLKTRRNHEQEQTFPGGGSTIYSMIQSQSSAPTSQEPAYTLYSLIQPSRKSGSRKRNHSPSFNSTIYEVIGKSQPKAQNPARLSRKELENFDVYS

SEQ ID NO: 984 - protein, 220 aa, Homo sapiens
MLRLLLALNLFPSIQVTGNKILVKQSPMLVAYDNAVNLSCKYSYNLFSREFRASLHKGLDSAVEVCVVYGNYSQQLQVYSKTGFNCDGKLGNESVTFYLQNLYVNQTDIYFCKIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRS

SEQ ID NO: 985 - protein, 187 aa, Homo sapiens
RRACRKRIRQKLHLCYPVQTSQPKLELVDSRPRRSSTQLRSGASVTEPVAEERGLMSQPLMETCHSVGAAYLESLPLQDASPAGGPSSPRDLPEPRVSTEHTNNKIEKIYIMKADTVIVGTVKAELPEGRGLAGPAEPELEEELEADHTPHYPEQETEPPLGSCSDVMLSVEEEGKEDPLPTAASGK

SEQ ID NO: 986 - protein, 187 aa, Homo sapiens; identical to SEQ ID NO: 985

SEQ ID NO: 987 - protein, 54 aa, Homo sapiens
HIWQLRSQCMWPRETQLLLEVPPSTEDARSCQFPEEERGERSAEEKGRLGDLWV

SEQ ID NO: 988 - protein, 60 aa, Homo sapiens
CVKRRKPRGDVVKVIVSVQRKRQEAEGEATVIEALQAPPDVTTVAVEETIPSFTGRSPNH

SEQ ID NO: 989 - protein, 38 aa, Homo sapiens
CWLTKKKYSSSVHDPNGEYMFMRAVNTAKKSRLTDVTL

SEQ ID NO: 990 - protein, 54 aa, Homo sapiens
HLWRRQWRPRRFSALEQGIHPPQAQSKIEELEQEPEPEPEPEPEPEPEPEPEQL

SEQ ID NO: 991 - protein, 42 aa, Homo sapiens
ALYLLRRDQRLPPDAHKPPGGGSFRTPIQEEQADAHSTLAKI

SEQ ID NO: 992 - protein, 37 aa, Homo sapiens
RRDQRLPPDAHKPPGGGSFRTPIQEEQADAHSTLAKI

SEQ ID NO: 993 - protein, 49 aa, Homo sapiens
HQRRKYRSNKGESPVEPAEPCRYSCPREEEGSTIPIQEDYRKPEPACSP

SEQ ID NO: 994 - protein, 111 aa, Homo sapiens
RRHQGKQNELSDTAGREINLVDAKLKSEQTEASTRQNSQVLLSETGIYDNDPDLCFRMQEGSEVYSNPCLEENKPGIVYASLNHSVIGPNSRLARNVKEAPTEYASICVRS

SEQ ID NO: 995 - protein, 111 aa, Homo sapiens
RRHQGKQNELSDTAGREINLVDAHLKSEQTEASTRQNSQVLLSETGIYDNDPDLCFRMQEGSEVYSNPCLEENKPGIVYASLNHSVIGPNSRLARNVKEAPTEYASICVRS

SEQ ID NO: 996 - protein, 114 aa, Homo sapiens
CCLRRHQGKQNELSDTAGREINLVDAHLKSEQTEASTRQNSQVLLSETGIYDNDPDLCFRMQEGSEVYSNPCLEENKPGIVYASLNHSVIGPNSRLARNVKEAPTEYASICVRS

SEQ ID NO: 997 - protein, 44 aa, Homo sapiens
FWVRSKRSRLLHSDYMNMTPRRPGPTRKHYQPYAPPRDFAAYRS

SEQ ID NO: 998 - protein, 41 aa, Homo sapiens
RSKRSRGGHSDYMNMTPRRPGPTRKHYQPYAPPRDFAAYRS

SEQ ID NO: 999 - protein, 43 aa, Homo sapiens
RSKRSRGGHSDYIVINMTPRRPGPTRKHYQPYAPPRDFAAYRS

SEQ ID NO: 1000 - protein, 5 aa, Homo sapiens
DKTHT

SEQ ID NO: 1001 - protein, 4 aa, Homo sapiens
CPPC

SEQ ID NO: 1002 - protein, 15 aa, Homo sapiens
CPEPKSCDTPPPCPR

SEQ ID NO: 1003 - protein, 12 aa, Homo sapiens
ELKTPLGDTTHT

SEQ ID NO: 1004 - protein, 10 aa, Homo sapiens
KSCDKTHTCP

SEQ ID NO: 1005 - protein, 7 aa, Homo sapiens
KCCVDCP

SEQ ID NO: 1006 - protein, 7 aa, Homo sapiens
KYGPPCP

SEQ ID NO: 1007 - protein, 16 aa, Homo sapiens
VEPKSPDKTHTCPPCP

SEQ ID NO: 1008 - protein, 16 aa, Homo sapiens
LDPKSSDKTHTCPPCP

SEQ ID NO: 1009 - protein, 39 aa, Homo sapiens
IEVMYPPPYLDNEKSNGTIIHVKGKHLCPSPLFPGPSKP

SEQ ID NO: 1010 - protein, 12 aa, Homo sapiens
GGAVHTRGLDFA

SEQ ID NO: 1011 - protein, 45 aa, Homo sapiens
TTTPAPRPPTPAPTIASQPLSLRPEACRPAAGGAVHTRGLDFACD

SEQ ID NO: 1012 - DNA, 135 bp, Artificial Sequence
  source: /note="Description of Artificial Sequence: Synthetic Construct"
accacaaccccagcacctcgcccaccaacaccagcaccaaccatcgcatcccagccactgtctctgaggcccgaggcatgtaggcctgcagcaggaggcgccgtgcacaccaggggcctggactttgcctgcgat

SEQ ID NO: 1013 - DNA, 135 bp, Artificial Sequence
  source: /note="Description of Artificial Sequence: Synthetic Construct"
acaacaaccccagcacccagacctccaacacctgcaccaaccatcgcaagccagcctctgtccctgaggcccgaggcatgtaggccagcagcaggaggcgccgtgcacacccggggcctggactttgcctgcgat

SEQ ID NO: 1014 - DNA, 135 bp, Artificial Sequence
  source: /note="Description of Artificial Sequence: Synthetic Construct"
accacaaccccagcaccccgcccaccaacacctgcaccaaccatcgcctcccagccactgtctctgaggcccgaggcatgtaggcctgcagcaggaggcgccgtgcacaccaggggcctggactttgcctgcgat

SEQ ID NO: 1015 - DNA, 135 bp, Artificial Sequence
  source: /note="Description of Artificial Sequence: Synthetic Construct"
accacaaccccagcacccagaccaccaacacctgcaccaaccatcgcaagccagcctctgtccctgcgcccagaggcatgcaggccagcagcaggaggagcagtgcacacccggggcctggacttcgcatgtgat

SEQ ID NO: 1016 - DNA, 135 bp, Artificial Sequence
  source: /note="Description of Artificial Sequence: Synthetic Construct"
accacaaccccagcacctcgcccaccaacaccagcaccaaccatcgcatcccagccactgtctctgcgccccgaggcatgcaggcctgcagcaggcggcgccgtgcacaccaggggcctggacttcgcctgtgat

SEQ ID NO: 1017 - DNA, 135 bp, Artificial Sequence
  source: /note="Description of Artificial Sequence: Synthetic Construct"
accacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgat

SEQ ID NO: 1018 - protein, 48 aa, Homo sapiens
AKPTTTPAPRPPTPAPTIASQPLSLRPEACRPAAGGAVHTRGLDFACD

SEQ ID NO: 1019 - protein, 79 aa, Homo sapiens
TTTPAPRPPTPAPTIASQPLSLRPEACRPAAGGAVHTRGLDFACDEPKSPDKTHTCPPCPAPPVAGPSVFLFPPKPKDT

SEQ ID NO: 1020 - protein, 51 aa, Homo sapiens
PAKPTTTPAPRPPTPAPTIASQPLSLRPEACRPAAGGAVHTRGLDFACDIY

SEQ ID NO: 1021 - protein, 69 aa, Homo sapiens
TTTPAPRPPTPAPTIASQPLSLRPEACRPAAGGAVHTRGLDFACDIYIWAPLAGTCGVLLLSLVITLYC

SEQ ID NO: 1022 - DNA, 207 bp, Homo sapiens
accacaaccccagcacctcgcccaccaacaccagcaccaaccatcgcatcccagccactgtctctgaggcccgaggcatgtaggcctgcagcaggaggcgccgtgcacaccaggggcctggactttgcctgcgatatctatatctgggcaccactggcaggaacatgtggcgtgctgctgctgtccctggtcatcaccctgtattgc

SEQ ID NO: 1023 - DNA, 207 bp, Homo sapiens
accacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgc

SEQ ID NO: 1024 - DNA, 207 bp, Homo sapiens
accacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcactttactgccc

SEQ ID NO: 1025 - DNA, 207 bp, Homo sapiens
acaacaaccccagcacccagacctccaacacctgcaccaaccatcgcaagccagcctctgtccctgaggcccgaggcatgtaggccagcagcaggaggcgccgtgcacacccggggcctggactttgcctgcgatatctatatctgggcaccactggcaggaacatgtggcgtgctgctgctgtccctggtcatcaccctgtattgc

SEQ ID NO: 1026 - DNA, 207 bp, Homo sapiens
accacaaccccagcaccccgcccaccaacacctgcaccaaccatcgcctcccagccactgtctctgaggcccgaggcatgtaggcctgcagcaggaggcgccgtgcacaccaggggcctggactttgcctgcgatatctacatctgggcacctctggcaggaacatgtggcgtgctgctgctgtccctggtcatcaccctgtattgc

SEQ ID NO: 1027 - DNA, 207 bp, Homo sapiens
accacaaccccagcacccagaccaccaacacctgcaccaaccatcgcaagccagcctctgtccctgcgcccagaggcatgcaggccagcagcaggaggagcagtgcacacccggggcctggacttcgcatgtgatatctacatctgggcaccactggcaggaacatgcggcgtgctgctgctgtccctggtcatcaccctgtattgt

SEQ ID NO: 1028 - DNA, 207 bp, Homo sapiens
accacaaccccagcacctcgcccaccaacaccagcaccaaccatcgcatcccagccactgtctctgcgccccgaggcatgcaggcctgcagcaggcggcgccgtgcacaccaggggcctggacttcgcctgtgatatctacatctgggcacctctggcaggaacatgcggcgtgctgctgctgtctctggtcatcaccctgtattgt

SEQ ID NO: 1029 - DNA, 207 bp, Homo sapiens
accacaaccccagcacctagaccaccaacaccagcacccaccatcgcctctcagccactgagcctgcgccccgaggcatgtaggcctgcagcaggcggcgccgtgcacaccaggggcctggactttgcctgcgatatctacatctgggcaccactggcaggaacatgtggcgtgctgctgctgtccctggtcatcaccctgtactgc

SEQ ID NO: 1030 - protein, 44 aa, Homo sapiens
TTPAPRPPTPAPTIASQPLSLRPEACRPAAGGAVHTRGLDFACD

SEQ ID NO: 1031 - protein, 47 aa, Homo sapiens
TTTPAPRPPTPAPTIASQPLSLRPEACRPAAGGAVHTRGLDFACDIY

SEQ ID NO: 1032 - protein, 11 aa, Homo sapiens
LDKTHTCPPCP

SEQ ID NO: 1033 - protein, 16 aa, Homo sapiens
GLAVSTISSFFPPGYQ

SEQ ID NO: 1034 - protein, 282 aa, Homo sapiens
RWPESPKAQASSVPTAQPQAEGSLAKATTAPATTRNTGRGGEEKKKEKEKEEQEERETKTPECPSHTQPLGVYLLTPAVQDLWLRDKATFTCFVVGSDLKDAHLTWEVAGKVPTGGVEEGLLERHSNGSQSQHSRLTLPRSLWNAGTSVTCTLNHPSLPPQRLMALREPAAQAPVKLSLNLLASSDPPEAASWLLCEVSGFSPPNILLMWLEDQREVNTSGFAPARPPPQPGSTTFWAWSVLRVPAPPSPQPATYTCVVSHEDSRTLLNASRSLEVSYVTDH

SEQ ID NO: 1035 - protein, 246 aa, Homo sapiens
YVTVSSQDPAEPKSPDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKKDPK

SEQ ID NO: 1036 - protein, 45 aa, Homo sapiens
KPTTTPAPRPPTPAPTIASQPLSLRPEACRPAAGGAVHTRGLDFA

SEQ ID NO: 1037 - protein, 16 aa, Homo sapiens
LEPKSCDKTHTCPPCP

SEQ ID NO: 1038 - protein, 43 aa, Homo sapiens
KPTTTPAPRPPTPAPTIASQPLSLRPEACRPAAGGAVHTRGLD

SEQ ID NO: 1039 - protein, 15 aa, Homo sapiens
EPKSCDKTHTCPPCP

SEQ ID NO: 1040 - protein, 16 aa, Homo sapiens
ELKTPLGDTHTCPRCP

SEQ ID NO: 1041 - protein, 15 aa, Homo sapiens
EPKSCDTPPPCPRCP

SEQ ID NO: 1042 - protein, 12 aa, Homo sapiens
ESKYGPPCPSCP

SEQ ID NO: 1043 - protein, 12 aa, Homo sapiens
ERKCCVECPPCP

SEQ ID NO: 1044 - protein, 229 aa, Homo sapiens
ESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 1045 - protein, 119 aa, Homo sapiens
ESKYGPPCPPCPGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 1046 - protein, 281 aa, Homo sapiens
RWPESPKAQASSVPTAQPQAEGSLAKATTAPATTRNTGRGGEEKKKEKEKEEQEERETKTPECPSHTQPLGVYLLTPAVQDLWLRDKATFTCFVVGSDLKDAHLTWEVAGKVPTGGVEEGLLERHSNGSQSQHSRLTLPRSLWNAGTSVTCTLHPSLPPQRLMALREPAAQAPVKLSLNLLASSDPPEAASWLLCEVSGFSPPNILLMWLEDQREVNTSGFAPARPPPQPGSTTFWAWSVLRVPAPPSPQPATYTCVVSHEDSRTLLNASRSLEVSYVTDH

SEQ ID NO: 1047 - protein, 283 aa, Homo sapiens
RWPESPKAQASSVPTAQPQAEGSLAKATTAPATTRNTGRGGEEKKKEKEKEEQEERETKTPECPSHTQPLGVYLLTPAVQDLWLRDKATFTCFVVGSDLKDAHLTWEVAGKVPTGGVEEGLLERHSNGSQSQHSRLTLPRSLWNAGTSVTCTLNHPSLPPQRLMALREPAAQAPVKLSLNLLASSDPPEAASWLLCEVSGFSPPNILLMVVLEDQREVNTSGFAPARPPPQPGSTTFWAWSVLRVPAPPSPQPATYTCVVSHEDSRTLLNASRSLEVSYVTDH

SEQ ID NO: 1048 - protein, 58 aa, Homo sapiens
ESPKAQASSVPTAQPQAEGSLAKATTAPATTRNTGRGGEEKKKEKEKEEQEERETKTP

SEQ ID NO: 1049 - protein, 234 aa, Homo sapiens
AEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKKD

SEQ ID NO: 1050 - protein, 234 aa, Homo sapiens; identical to SEQ ID NO: 1049

SEQ ID NO: 1051 - protein, 20 aa, Homo sapiens
AEPKSPDKTHTCPPCPKDPK

SEQ ID NO: 1052 - protein, 233 aa, Homo sapiens
EPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEVKCKVSNKALPAPIEKTISKAKGQPREPQVYTLPPSRDELTKNQVSLTCLVKGFYPSDIAVEWESNGQPENNYKTTPPVLDSDGSFFLVSKLTVDKSRWQQGNVFSCSVMHEALHNHYTQKSLSLSPGKKD

SEQ ID NO: 1053 - protein, 13 aa, Homo sapiens
SVFLFPPKPKDTL

SEQ ID NO: 1054 - protein, 231 aa, Homo sapiens
EPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1055 - protein, 235 aa, Homo sapiens
EPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKKDPK

SEQ ID NO: 1056 - protein, 223 aa, Homo sapiens
VECPPCPAPPVAGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1057 - protein, 235 aa, Homo sapiens
DPAEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKK

SEQ ID NO: 1058 - protein, 17 aa, Homo sapiens
ELKTPLGDTTHTCPRCP

SEQ ID NO: 1059 - protein, 61 aa, Homo sapiens
ELKTPLGDTHTCPRCPEPKSCDTPPPCPRCPEPKSCDTPPPCPRCPEPKSCDTPPPCPRCP

SEQ ID NO: 1060 - protein, 230 aa, Homo sapiens
ESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKM

SEQ ID NO: 1061 - protein, 230 aa, Homo sapiens
ESKYGPPCPPCPAPEFEGGPSVFLFPPKPKDTLMISRTPEVTCVVVDVSQEDPEVQFNWYVDGVEVHNAKTKPREEQFQSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKM

SEQ ID NO: 1062 - protein, 12 aa, Homo sapiens
SPNMVPHAHHAQ

SEQ ID NO: 1063 - protein, 107 aa, Homo sapiens
GQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 1064 - protein, 129 aa, Homo sapiens
ESKYGPPCPPCPGGGSSGGGSGGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 1065 - protein, 229 aa, Homo sapiens
ESKYGPPCPSCPAPEFEGGPSVFLFPPKPKDTLMISRTPEVTCVVVDVSQEDPEVQFNWYVDGVEVHQAKTKPREEQFNSTYRVVSVLTVLHQDWLNGKEYKCKVSNKGLPSSIEKTISKAKGQPREPQVYTLPPSQEEMTKNQVSLTCLVKGFVPSDIAVEWESNGQPENNYKTTPPVLDSDGSFFLYSRLTVDKSRWQEGNVFSCSVMHEALHNHYTQKSLSLSLGK

SEQ ID NO: 1066 - protein, 229 aa, Homo sapiens
ESKYGPPCPPCPAPEFEGGPSVFLFPPKPKDTLMISRTPEVTCVVVDVSQEDPEVQFNWYVDGVEVHQAKTKPREEQFNSTYRVVSVLTVLHQDWLNGKEYKCKVSNKGLPSSIEKTISKAKGQPREPQVYTLPPSQEEMTKNQVSLTCLVKGFVPSDIAVEWESNGQPENNYKTTPPVLDSDGSFFLYSRLTVDKSRWQEGNVFSCSVMHEALHNHYTQKSLSLSLGK

SEQ ID NO: 1067 - DNA, 36 bp, Homo sapiens
gaatctaagtacggaccgccctgccccccttgccct

SEQ ID NO: 1068 - protein, 12 aa, Homo sapiens
ESKYGPPCPPCP

SEQ ID NO: 1069 - protein, 9 aa, Homo sapiens
YGPPCPPCP

SEQ ID NO: 1070 - protein, 10 aa, Homo sapiens
KYGPPCPPCP

SEQ ID NO: 1071 - protein, 13 aa, Homo sapiens
EVVKYGPPCPPCP

SEQ ID NO: 1072 - protein, 229 aa, Homo sapiens
ESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDLSRWQEGNVFSCSVMHEALHNHYTQKSLSLSLGK

SEQ ID NO: 1073 - protein, 22 aa, Homo sapiens
ESKYGPPCPPCPGGGSSGGGSG

SEQ ID NO: 1074 - protein, 231 aa, Homo sapiens
EPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTIPPVLDSDGSFFLYSKLTVDKSRWQQGNVFSCSVMHEALHNHYTQKSLSLSPGK

SEQ ID NO: 1075 - protein, 231 aa, Homo sapiens
EPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPLEKTISKAKGQPREPQVYTLPPSRDELTKNQVSLTCLVKGFYPSDIAVEWESNGQPENNYKTIPPVLDSDGSFFLYSKLTVDKSRWQQGNVFSCSVMHEALHNHYTQKSLSLSPGK

SEQ ID NO: 1076 - protein, 236 aa, Homo sapiens
EPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKKDPK

SEQ ID NO: 1077 - DNA, 135 bp, Artificial Sequence; identical to SEQ ID NO: 1017
  source: /note="Description of Artificial Sequence: Synthetic polynucleotide"

SEQ ID NO: 1078 - DNA, 690 bp, Artificial Sequence
  source: /note="Description of Artificial Sequence: Synthetic polynucleotide"
gagagcaagtacggccctccctgccccccttgccctgcccccgagttcctgggcggacccagcgtgttcctgttcccccccaagcccaaggacaccctgatgatcagccggacccccgaggtgacctgtgtggtggtggacgtgtcccaggaggaccccgaggtccagttcaactggtacgtggacggcgtggaggtgcacaacgccaagaccaagccccgggaggagcagttcaatagcacctaccgggtggtgtccgtgctgaccgtgctgcaccaggactggctgaacggcaaggaatacaagtgtaaggtgtccaacaagggcctgcccagcagcatcgagaaaaccatcagcaaggccaagggccagcctcgggagccccaggtgtacaccctgccccctagccaagaggagatgaccaagaaccaggtgtccctgacctgcctggtgaagggcttctaccccagcgacatcgccgtggagtgggagagcaacggccagcccgagaacaactacaagaccaccccccctgtgctggacagcgacggcagcttcttcctgtacagccggctgaccgtggacaagagccggtggcaggagggcaacgtctttagctgctccgtgatgcacgaggccctgcacaaccactacacccagaagagcctgagcctgtccctgggcaagatg

SEQ ID NO: 1079 - DNA, 847 bp, Artificial Sequence
  source: /note="Description of Artificial Sequence: Synthetic polynucleotide"
aggtggcccgaaagtcccaaggcccaggcatctagtgttcctactgcacagccccaggcagaaggcagcctagccaaagctactactgcacctgccactacgcgcaatactggccgtggcggggaggagaagaaaaaggagaaagagaaagaagaacaggaagagagggagaccaagacccctgaatgtccatcccatacccagccgctgggcgtctatctcttgactcccgcagtacaggacttgtggcttagagataaggccacctttacatgtttcgtcgtgggctctgacctgaaggatgcccatttgacttgggaggttgccggaaaggtacccacagggggggttgaggaagggttgctggagcgccattccaatggctctcagagccagcactcaagactcacccttccgagatccctgtggaacgccgggacctctgtcacatgtactctaaatcatcctagcctgcccccacagcgtctgatggcccttagagagccagccgcccaggcaccagttaagcttagcctgaatctgctcgccagtagtgatcccccagaggccgccagctggctcttatgcgaagtgtccggctttagcccgcccaacatcttgctcatgtggctggaggaccagcgagaagtgaacaccagcggcttcgctccagcccggcccccaccccagccgggttctaccacattctgggcctggagtgtcttaagggtcccagcaccacctagcccccagccagccacatacacctgtgttgtgtcccatgaagatagcaggaccctgctaaatgcttctaggagtctggaggtttcctacgtgactgaccatt

SEQ ID NO: 1080 - protein, 619 aa, Homo sapiens
MPDPAAHLPFFYGSISRAEAEEHLKLAGMADGLFLLRQCLRSLGGYVLSLVHDVRFHHFPIERQLNGTYAIAGGKAHCGPAELCEFYSRDPDGLPCNLRKPCNRPSGLEPQPGVFDCLRDAMVRDYVRQTWKLEGEALEQAIISQAPQVEKLIATTAHERMPWYHSSLTREEAERKLYSGAQTDGKFLLRPRKEQGTYALSLIYGKTVYHYLISQDKAGKYCIPEGTKFDTLWQLVEYLKLKADGLIYCLKEACPNSSASNASGAAAPTLPAHPSTLTHPQRRIDTLNSDGYTPEPARITSPDKPRPMPMDTSVYESPYSDPEELKDKKLFLKRDNLLIADIELGCGNFGSVRQGVYRMRKKQIDVAIKVLKQGTEKADTEEMMREAQIMHQLDNPYIVRLIGVCQAEALMLVMEMAGGGPLHKFLVGKREEIPVSNVAELLHQVSMGMKYLEEKNFVHRDLAARNVLLVNRHYAKISDFGLSKALGADDSYYTARSAGKWPLKWYAPECINFRKFSSRSDVWSYGVTMWEALSYGQKPYKKMKGPEVMAFIEQGKRMECPPECPPELYALMSDCWIYKWEDRPDFLTVEQRMRACYYSLASKVEGPPGSTQKAEAACA

SEQ ID NO: 1081 - protein, 180 aa, Homo sapiens
MLRLLLALNLFPSIQVTGNKILVKQSPMLVAYDNAVNLSCKYSYNLFSREFRASLHKGLDSAVEVCVVYGNYSQQLQVYSKTGFNCDGKLGNESVTFYLQNLYVNQTDIYFCKIEVMYPPPYLDNEKSNGTIIHVKGKHLCPSPLFPGPSKPFWVLVVVGGVLACYSLLVTVAFIIFWVR

SEQ ID NO: 1082 - protein, 240 aa, Homo sapiens
MGNSCYNIVATLLLVLNFERTRSLQDPCSNCPAGTFCDNNRNQICSPCPPNSFSSAGGQRTCDICRQCKGVFRTRKECSSTSNAECDCTPGFHCLGAGCSMCEQDCKQGQELTKKGCKDCCFGTFNDQKRGICRPWTNCSLDGKSVLVNGTKERDVVCGPSPADLSPGASSVTPPAPAREPGHSPQIISFFLALTSTALLFLLFFLTLRFSVVKRGRKKLLYIFKQPFMRPVQTTQEEDG

SEQ ID NO: 1083 - protein, 21 aa, Homo sapiens
DGVYTGLSTRNQETYETLKHE

SEQ ID NO: 1084 - protein, 66 aa, Homo sapiens
DPKLCYILDAILFLYGIVLTLLYCRLKIQVRKAAITSYEKSDGVYTGLSTRNQETYETLKHEKPPQ

SEQ ID NO: 1085 - protein, 21 aa, Homo sapiens
DGVYTGLSTRNQETYETLKHE

SEQ ID NO: 1086 - protein, 67 aa, Homo sapiens
IEVMYPPPYLDNEKSNGTIIHVKGKHLCPSPLFPGPSKPFWVLVVVGGVLACYSLLVTVAFIIFWVR

SEQ ID NO: 1087 - protein, 219 aa, Homo sapiens
IEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1088 - protein, 283 aa, Homo sapiens
FVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1089 - protein, 48 aa, Artificial Sequence
  source: /note="Description of Artificial Sequence: Synthetic polypeptide"
QRRKYRSNKGESPVEPAEPCRYSCPREEEGSTIPIQEDYRKPEPACSP

SEQ ID NO: 1090 - DNA, 123 bp, Artificial Sequence
  source: /note="Description of Artificial Sequence: Synthetic polynucleotide"
aggagtaagaggagcaggctcctgcacagtgactacatgaacatgactccccgccgccccgggcccacccgcaagcattaccagccctatgccccaccacgcgacttcgcagcctatcgctcc

SEQ ID NO: 1091 - DNA, 336 bp, Artificial Sequence
  source: /note="Description of Artificial Sequence: Synthetic polynucleotide"
cgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 1092 - DNA, 336 bp, Artificial Sequence
  source: /note="Description of Artificial Sequence: Synthetic polynucleotide"
agagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1093 - DNA, 105 bp, Artificial Sequence
  source: /note="Description of Artificial Sequence: Synthetic polynucleotide"
acaaaaaagaagtattcatccagtgtgcacgaccctaacggtgaatacatgttcatgagagcagtgaacacagccaaaaaatccagactcacagatgtgacccta

SEQ ID NO: 1094 - protein, 42 aa, Homo sapiens
KRGRKKLLYIFKQPFMRPVQTIQEEDGCSCRFPEEEEGGCEL

SEQ ID NO: 1095 - protein, 42 aa, Homo sapiens
KRGRKKLLYIFKQPFMRPVQTTQEEDGCSCRFPEEEEGGYEL

SEQ ID NO: 1096 - protein, 225 aa, Homo sapiens
TGTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1097 - protein, 154 aa, Homo sapiens
KRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1098 - protein, 194 aa, Homo sapiens
KRIKPIVWPSLPDHKKTLEHLCKKPRKNLNVSFNPESFLDCQIHRVDDIQARDEVEGFLQDTFPQQLEESEKQRLGGDVQSPNCPSEDVVITPESFGRDSSLTCLAGNVSACDAPILSSSRSLDCRESGKNGPHVYQDLLLSLGTTNSTLPPPFSLQSGILTLNPVAQGQPILTSLGSNQEEAYVTMSSFYQNQ

SEQ ID NO: 1099 - protein, 47 aa, Homo sapiens
RFSVVKRGRKKLLYIFKQPFMRPVQTTQEEDGCSCRFPEEEEGGCEL

SEQ ID NO: 1100 - protein, 341 aa, Homo sapiens
RKKRKDAKNNEVSFSQIKPKKSKLIRVENFEAYFKKQQADSNCGFAEEYEDLKLVGISQPKYAAELAENRGKNRYNNVLPYDISRVKLSVQTHSTDDYINANYMPGYHSKKDFIATQGPLPNTLKDFWRMVWEKNVYAIIMLTKCVEQGRTKCEEYWPSKQAQDYGDITVAMTSEIVLPEWTIRDFTVKNIQTSESHPLRQFHFTSWPDHGVPDTTDLLINFRYLVRDYMKQSPPESPILVHCSAGVGRTGTFIAIDRLIYQIENENTVDVYGIVYDLRMHRPLMVQTEDQYVFLNQCVLDIVRSQKDSKVDLIYQNTTAMTIYENLAPVTTFGKTNGYIA

SEQ ID NO: 1101 - protein, 48 aa, Homo sapiens
QRRKYRSNKGESPVEPAEPCHYSCPREEEGSTIPIQEDYRKPEPACSP

SEQ ID NO: 1102 - protein, 6 aa, Homo sapiens
FAAYRS

SEQ ID NO: 1103 - protein, 68 aa, Homo sapiens; identical to SEQ ID NO: 381

SEQ ID NO: 1104 - protein, 41 aa, Homo sapiens
RSKRSRLLHSDYMNMTPRRPGPTRKHYQPYAPPRDFAAYRS

SEQ ID NO: 1105 - protein, 40 aa, Homo sapiens
SKRSRLLHSDYMNMTPRRPGPTRKHYQPYAPPRDFAAYRS

SEQ ID NO: 1106 - protein, 106 aa, Homo sapiens
IEVMYPPPYLDNEKSNGTIIHVKGKHLCPSPLFPGPSKPFWVLVVVGGVLACYSLLVTVAFIIFWRSKRSRLLHSDYMNMTPRRPGPTRKHYQPYAPPRDFAAYRS

SEQ ID NO: 1107 - protein, 200 aa, Homo sapiens
RSKRSRLLHSDYMNMTPRRPGPTRKHYQPYAPPRDFAAYRSRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1108 - protein, 188 aa, Homo sapiens
RSKRSRLLHSDYNMTPRRPGPTRKHYQPYAPPRDFAAYRSRDQRLPPDAHKPPGGGSFRTPIQEEQADAHSTLAKIRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1109 - protein, 70 aa, Homo sapiens
MFWVLVVVGGVLACYSLLVTVAFIIFWVKRGRKKLLYIFKQPFMRPVQTTQEEDGCSCRFPEEEEGGCEL

SEQ ID NO: 1110 - protein, 108 aa, Homo sapiens
IEVMYPPPYLDNEKSNGTIIHVKGKHLCPSPLFPGPSKPFWVLVVVGGVLACYSLLVTVAFIIFWVKRGRKKLLYIFKQPFMRPVQTTQEEDGCSCRFPEEEEGGCEL

SEQ ID NO: 1111 - protein, 153 aa, Homo sapiens
RSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1112 - protein, 151 aa, Homo sapiens
KRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1113 - protein, 171 aa, Homo sapiens
MEHSTFLSGLVLATLLSQVSPFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNK

SEQ ID NO: 1114 - protein, 127 aa, Homo sapiens
MEHSTFLSGLVLATLLSQVSPFKIPIEELEDRVFVNCNTSITWVEGTVGTLLSDITRLDLGKRILDPRGIYRCNGTDIYKDKESTVQVHYRTADTQALLRNDQVYQPLRDRDDAQYSHLGGNWARNK

SEQ ID NO: 1115 - protein, 21 aa, Homo sapiens
DQVYQPLRDRDDAQYSHLGGN

SEQ ID NO: 1116 - protein, 171 aa, Homo sapiens; identical to SEQ ID NO: 1113

SEQ ID NO: 1117 - protein, 127 aa, Homo sapiens; identical to SEQ ID NO: 1114

SEQ ID NO: 1118 - protein, 21 aa, Homo sapiens
DQVYQPLRDRDDAQYSHLGGN

SEQ ID NO: 1119 - protein, 207 aa, Homo sapiens
MQSGTHWRVLGLCLLSVGVWGQDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRI

SEQ ID NO: 1120 - protein, 21 aa, Homo sapiens
NPDYEPIRKGQRDLYSGLNQR

SEQ ID NO: 1121 - protein, 182 aa, Homo sapiens
MEQGKGLAVLILAIILLQGTLAQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRN

SEQ ID NO: 1122 - protein, 21 aa, Homo sapiens
DQLYQPLKDREDDQYSHLQGN

SEQ ID NO: 1123 - protein, 21 aa, Homo sapiens
DQLYQPLKDREDDQYSHLQGN

SEQ ID NO: 1124 - protein, 182 aa, Homo sapiens; identical to SEQ ID NO: 1121

SEQ ID NO: 1125 - protein, 163 aa, Homo sapiens
MKWKALFTAAILQAQLPITEAQSFGLLDPKLCYLLDGILFIYGVILTALFLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1126 - protein, 164 aa, Homo sapiens
MKWKALFTAAILQAQLPITEAQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPR

SEQ ID NO: 1127 - protein, 164 aa, Homo sapiens; identical to SEQ ID NO: 1126

SEQ ID NO: 1128 - protein, 21 aa, Homo sapiens
NQLYNELNLGRREEYDVLDKR

SEQ ID NO: 1129 - protein, 112 aa, Homo sapiens
RVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1130 - protein, 21 aa, Homo sapiens
DGLYQGLSTATKDTYDALHMQ

SEQ ID NO: 1131 - protein, 112 aa, Homo sapiens
RVKFSRSAEPPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1132 - protein, 113 aa, Homo sapiens
RVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPR

SEQ ID NO: 1133 - protein, 114 aa, Homo sapiens
RSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1134 - protein, 98 aa, Homo sapiens
RVKFSRSADAPAYQQGEYDVLDKRRGRDPEMGGKPRRKNPQEGLYNELQKDKMAEAYSEIGMKGERRRGKGHDGLYQGLSTATKDTYDALHMQALPPR

SEQ ID NO: 1135 - protein, 112 aa, Homo sapiens
RVKFSRSADAPAYQQGQNQLYNELNLGRREEVDVLDKRRGRDPEMGGKPRRKNPQEGLYNELQKDKMAEAYSEIGMKGERRRGKGHDGLYQGLSTATKDTYDALHMQALPPR

SEQ ID NO: 1136 - protein, 173 aa, Homo sapiens
MIPAVVLLLLLLVEQAAALGEPQLCYILDAILFLVGIVLTLLVCRLKIQVRKAAITSYEKSRVKFSRSADAPAYQQGQNQLYNELNLGRREEYDVLDKRRGRDPEMGGKPRRKNPQEGLYNELQKDKMAEAVSEIGMKGERRRGKGHDGLYQGLSTATKDTYDALHMQALPPR

SEQ ID NO: 1137 - protein, 113 aa, Homo sapiens
LRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1138 - protein, 60 aa, Homo sapiens
RVKFSRSADAPAYQQGQNQLYNELNLGRREEYDVLDKRRGRDPEMGGKPQRRKNPQEGLY

SEQ ID NO: 1139 - protein, 114 aa, Homo sapiens
LRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPR

SEQ ID NO: 1140 - protein, 113 aa, Homo sapiens
RRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1141 - protein, 21 aa, Homo sapiens
NQLYNELNLGRREEYDVLDKR

SEQ ID NO: 1142 - protein, 22 aa, Homo sapiens
EGLYNELQKDKMAEAYSEIGMK

SEQ ID NO: 1143 - protein, 21 aa, Homo sapiens
DGLYQGLSTATKDTYDALHMQ

SEQ ID NO: 1144 - protein, 112 aa, Homo sapiens; identical to SEQ ID NO: 1129

SEQ ID NO: 1145 - protein, 112 aa, Homo sapiens
RVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1146 - DNA, 338 bp, Artificial Sequence
  source: /note="Description of Artificial Sequence: Synthetic Construct"
agggtgaagttttctaggagcgccgatgcaccagcatataagcagggacagaaccagctgtacaacgagctgaatctgggcaggagagaggagtacgacgtgctggataagaggaggggaagggaccccgagatgggaggcaagccaaggagaaagaacccccaggagggcctgtataatgagctgcagaaggacaagatggccgaggcctactccgagatcggcatgaagggagagcggcgcaggggcaagggacacgatggcctgtatcagggcctgtctacagccaccaaggacacctacgatgcactgcacatgcaggccctgcctccaaggtg

SEQ ID NO: 1147 - DNA, 338 bp, Artificial Sequence
  source: /note="Description of Artificial Sequence: Synthetic Construct"
agggtgaagttttccaggtctgccgatgcccccgcctataagcagggccagaatcagctgtacaacgagctgaatctgggcaggagagaggagtacgacgtgctggataagaggaggggacgcgaccccgagatgggaggcaagcctaggagaaagaacccacaggagggcctgtataatgagctgcagaaggacaagatggccgaggcctactctgagatcggcatgaagggagagcggcgcaggggcaagggacacgatggcctgtatcagggcctgagcacagccaccaaggacacctacgatgcactgcacatgcaggccctgccacctaggtg

SEQ ID NO: 1148 - DNA, 338 bp, Artificial Sequence
  source: /note="Description of Artificial Sequence: Synthetic Construct"
agggtgaagtttagcaggtccgccgatgccccagcctataagcagggccagaaccagctgtacaacgagctgaatctgggcaggagggaagagtacgacgtgctggataagaggagaggaagggaccccgagatgggaggcaagccaaggaggaagaacccacaggagggcctgtataatgagctgcagaaggacaagatggccgaggcctacagcgagatcggcatgaagggagagaggagacggggcaagggacacgatggcctgtatcagggcctgtccacagccaccaaggacacctacgatgcactgcacatgcaggccctgcctccaaggtg

SEQ ID NO: 1149 - DNA, 338 bp, Artificial Sequence
  source: /note="Description of Artificial Sequence: Synthetic Construct"
agggtgaagttttccaggtctgccgatgccccagcctataagcagggccagaatcagctgtacaacgagctgaatctgggcaggagagaggagtacgacgtgctggataagaggaggggacgcgaccccgagatgggaggcaagcctaggagaaagaacccacaggagggcctgtataatgagctgcagaaggacaagatggccgaggcctactctgagatcggcatgaagggagagcggcgcaggggcaagggacacgatggcctgtatcagggcctgagcacagccaccaaggacacctacgatgcactgcacatgcaggccctgccacctaggtg

SEQ ID NO: 1150 - DNA, 338 bp, Artificial Sequence
  source: /note="Description of Artificial Sequence: Synthetic Construct"
agggtgaagtttagcaggtccgccgatgccccagcctataagcagggccagaaccagctgtacaacgagctgaatctgggcaggagggaagagtacgacgtgctggataagaggagaggaagggaccccgagatgggaggcaagccaaggaggaagaacccacaggagggcctgtataatgagctgcagaaggacaagatggccgaggcctactccgagatcggcatgaagggagagaggagacggggcaagggacacgatggcctgtatcagggcctgtctacagccaccaaggacacctacgatgcactgcacatgcaggccctgcctccaaggtg

SEQ ID NO: 1151 - DNA, 336 bp, Artificial Sequence
  source: /note="Description of Artificial Sequence: Synthetic polynucleotide"
agagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1152 - DNA, 336 bp, Artificial Sequence
  source: /note="Description of Artificial Sequence: Synthetic Construct"
agagtgaagttttccaggtctgccgatgccccagcctacaagcagggccagaatcagctgtataacgagctgaatctgggccggagagaggagtacgacgtgctggataagaggaggggacgggaccccgagatgggaggcaagccacggagaaagaacccccaggagggcctgtacaatgagctgcagaaggacaagatggccgaggcctattctgagatcggcatgaagggagagaggcgccggggcaagggacacgatggcctgtaccagggcctgagcacagccaccaaggacacctatgatgcactgcacatgcaggccctgcctccaagg

SEQ ID NO: 1153 - DNA, 336 bp, Artificial Sequence
  source: /note="Description of Artificial Sequence: Synthetic Construct"
agggtgaagttttctaggagcgccgatgcaccagcatataagcagggacagaaccagctgtacaacgagctgaatctgggcaggagagaggagtacgacgtgctggataagaggaggggaagggaccccgagatgggaggcaagccaaggagaaagaacccccaggagggcctgtataatgagctgcagaaggacaagatggccgaggcctactccgagatcggcatgaagggagagcggcgcaggggcaagggacacgatggcctgtatcagggcctgtctacagccaccaaggacacctacgatgcactgcacatgcaggccctgcctccaagg

SEQ ID NO: 1154 - DNA, 336 bp, Artificial Sequence
  source: /note="Description of Artificial Sequence: Synthetic Construct"
agggtgaagttttccaggtctgccgatgcccccgcctataagcagggccagaatcagctgtacaacgagctgaatctgggcaggagagaggagtacgacgtgctggataagaggaggggacgcgaccccgagatgggaggcaagcctaggagaaagaacccacaggagggcctgtataatgagctgcagaaggacaagatggccgaggcctactctgagatcggcatgaagggagagcggcgcaggggcaagggacacgatggcctgtatcagggcctgagcacagccaccaaggacacctacgatgcactgcacatgcaggccctgccacctagg

SEQ ID NO: 1155 - DNA, 336 bp, Artificial Sequence
  source: /note="Description of Artificial Sequence: Synthetic Construct"
agggtgaagtttagcaggtccgccgatgccccagcctataagcagggccagaaccagctgtacaacgagctgaatctgggcaggagggaagagtacgacgtgctggataagaggagaggaagggaccccgagatgggaggcaagccaaggaggaagaacccacaggagggcctgtataatgagctgcagaaggacaagatggccgaggcctacagcgagatcggcatgaagggagagaggagacggggcaagggacacgatggcctgtatcagggcctgtccacagccaccaaggacacctacgatgcactgcacatgcaggccctgcctccaagg

SEQ ID NO: 1156 - DNA, 336 bp, Artificial Sequence
  source: /note="Description of Artificial Sequence: Synthetic Construct"
agggtgaagttttccaggtctgccgatgccccagcctataagcagggccagaatcagctgtacaacgagctgaatctgggcaggagagaggagtacgacgtgctggataagaggaggggacgcgaccccgagatgggaggcaagcctaggagaaagaacccacaggagggcctgtataatgagctgcagaaggacaagatggccgaggcctactctgagatcggcatgaagggagagcggcgcaggggcaagggacacgatggcctgtatcagggcctgagcacagccaccaaggacacctacgatgcactgcacatgcaggccctgccacctagg

SEQ ID NO: 1157 - DNA, 336 bp, Artificial Sequence
  source: /note="Description of Artificial Sequence: Synthetic Construct"
agggtgaagtttagcaggtccgccgatgccccagcctataagcagggccagaaccagctgtacaacgagctgaatctgggcaggagggaagagtacgacgtgctggataagaggagaggaagggaccccgagatgggaggcaagccaaggaggaagaacccacaggagggcctgtataatgagctgcagaaggacaagatggccgaggcctactccgagatcggcatgaagggagagaggagacggggcaagggacacgatggcctgtatcagggcctgtctacagccaccaaggacacctacgatgcactgcacatgcaggccctgcctccaagg

SEQ ID NO: 1158 - protein, 110 aa, Homo sapiens
RVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALP

SEQ ID NO: 1159 - protein, 137 aa, Homo sapiens
DPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPR

SEQ ID NO: 1160 - protein, 163 aa, Homo sapiens; identical to SEQ ID NO: 1125

SEQ ID NO: 1161 - protein, 38 aa, Homo sapiens
RSRDQRLPPDAHKPPGGGSFRTPIQEEQADAHSTLAKI

SEQ ID NO: 1162 - protein, 226 aa, Homo sapiens
MPGGPGVLQALPATIFLLFLLSAVYLGPGCQALWMHKVPASLMVSLGEDAHFQCPHNSSNNANVTWWRVLHGNYTWPPEFLGPGEDPNGTLIIQNVNKSHGGIYVCRVQEGNESYQQSCGTYLRVRQPPPRPFLDMGEGTKNRIITAEGIILLFCAVVPGTLLLFRKRWQNEKLGLDAGDEYEDENLYEGLNLDDCSMYEDISRGLQGTYQDVGSLNIGDVQLEKP

SEQ ID NO: 1163 - protein, 188 aa, Homo sapiens
MPGGPGVLQALPATIFLLFLLSAVYLGPGCQALWMHKVPASLMVSLGEDAHFQCPHNSSNNANVTWWRVLHGNYTWPPEFLGPGEDPNEPPPRPFLDMGEGTKNRIITAEGIILLFCAVVPGTLLLFRKRWQNEKLGLDAGDEYEDENLYEGLNLDDCSMYEDISRGLQGTYQDVGSLNIGDVQLEKP

SEQ ID NO: 1164 - protein, 226 aa, Homo sapiens; identical to SEQ ID NO: 1162

SEQ ID NO: 1165 - protein, 21 aa, Homo sapiens
ENLYEGLNLDDCSMYEDISRG

SEQ ID NO: 1166 - protein, 84 aa, Homo sapiens
FVPVFLPAKPTTTPAPRPPTPAPTIASQPLSLRPEACRPAAGGAVHTRGLDFACDIYIWAPLAGTCGVLLLSLVITLYCNHRNR

SEQ ID NO: 1167 - protein, 84 aa, Homo sapiens
FVPVFLPAKPITTPAPRPPTPAPTIASQPLSLRPEACRPAAGGAVHTRGLDFACDIYIWAPLAGTCGVLLLSLVITLYCNHRNR

SEQ ID NO: 1168 - protein, 47 aa, Homo sapiens
PTTTPAPRPPTPAPTIASQPLSLRPEACRPAAGGAVHTRGLDFACDI

SEQ ID NO: 1169 - protein, 41 aa, Homo sapiens
AVSLSKMLKKRSPLTTGVFVKMAPTEAECEKQFQPYFIPIN

SEQ ID NO: 1170 - protein, 47 aa, Homo sapiens
AVSLSKMLKKRSPLTTGVYMNMTPRRPECEKQFQPYAPPRDFAAYRS

SEQ ID NO: 1171 - protein, 20 aa, Homo sapiens
RPRRSPAQDGKVYINMPGRG

SEQ ID NO: 1172 - protein, 113 aa, Homo sapiens
MGGLEPCSRLLLLPLLLAVSGLRPVQAQAQSDCSCSTVSPGVLAGIVMGDLVLTVLIALAVYFLGRLVPRGRGAAEAATRKQRITETESPYQELQGQRSDVYSDLNTQRPYYK

SEQ ID NO: 1173 - protein, 112 aa, Homo sapiens
MGGLEPCSRLLLLPLLLAVSGLRPVQAQAQSDCSCSTVSPGVLAGIVMGDLVLTVLIALAVYFLGRLVPRGRGAAEATRKQRITETESPYQELQGQRSDVYSDLNTQRPYYK

SEQ ID NO: 1174 - protein, 102 aa, Homo sapiens
MGGLEPCSRLLLLPLLLAVSDCSCSTVSPGVLAGIVMGDLVLTVLIALAVYFLGRLVPRGRGAAEAATRKQRITETESPYQELQGQRSDVYSDLNTQRPYYK

SEQ ID NO: 1175 - protein, 101 aa, Homo sapiens
MGGLEPCSRLLLLPLLLAVSDCSCSTVSPGVLAGIVMGDLVLTVLIALAVYFLGRLVPRGRGAAEATRKQRITETESPYQELQGQRSDVYSDLNTQRPYYK

SEQ ID NO: 1176 - protein, 113 aa, Homo sapiens; identical to SEQ ID NO: 1172

SEQ ID NO: 1177 - protein, 112 aa, Homo sapiens; identical to SEQ ID NO: 1173

SEQ ID NO: 1178 - protein, 102 aa, Homo sapiens; identical to SEQ ID NO: 1174

SEQ ID NO: 1179 - protein, 101 aa, Homo sapiens; identical to SEQ ID NO: 1175

SEQ ID NO: 1180 - protein, 21 aa, Homo sapiens
ESPYQELQGQRSDVYSDLNTQ

SEQ ID NO: 1181 - protein, 21 aa, Homo sapiens
ESPYQELQGQRSDVYSDLNTQ

SEQ ID NO: 1182 - protein, 49 aa, Homo sapiens
RSQCMWPRETQLLLEVPPSTEDARSCQFPEEERGERSAEEKGRLGDLWV

SEQ ID NO: 1183 - protein, 35 aa, Homo sapiens
TKKKYSSSVHDPNGEFMFMRAVNTAKKSRLTDVTL

SEQ ID NO: 1184 - protein, 39 aa, Homo sapiens
KSRQTPPLASVEMEAMEALPVTWGTSSRDEDLENCSHHL

SEQ ID NO: 1185 - protein, 149 aa, Homo sapiens
RRDQRLPPDAHKPPGGGSFRTPIQEEQADAHSTLAKIRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1186 - protein, 69 aa, Artificial Sequence
  source: /note="Description of Artificial Sequence: Synthetic polypeptide"
TTTPAPRPPTPAPTIASQPLSLRPEACRPAAGGAVHTRGLDFACDFWLPIGCAAFVVVCILGCILICWL

SEQ ID NO: 1187 - DNA, 207 bp, Artificial Sequence
  source: /note="Description of Artificial Sequence: Synthetic polynucleotide"
accacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatttctggttacccataggatgtgcagcctttgttgtagtctgcattttgggatgcatacttatttgttggctt

SEQ ID NO: 1188 - protein, 46 aa, Homo sapiens
TTTPAPRPPTPAPTIASQPLSLRPEACRPAAGGAVHTRGLDFACDI

SEQ ID NO: 1189 - protein, 21 aa, Homo sapiens
FLVIIVILSALFLGTLACFCV

SEQ ID NO: 1190 - protein, 31 aa, Homo sapiens
IISFFLALTSTALLFLLFFLTLRFSVVKRGR

SEQ ID NO: 1191 - protein, 27 aa, Homo sapiens
IISFFLALTSTALLFLLFFLTLRFSVV

SEQ ID NO: 1192 - protein, 26 aa, Homo sapiens
VAAILGLGLVLGLLGPLAILLALYLL

SEQ ID NO: 1193 - protein, 363 aa, Homo sapiens
AVFGCIFGALVIVTVGGFIFWRKKRKDAKNNEVSFSQIKPKKSKLIRVENFEAYFKKQQADSNCGFAEEYEDLKLVGISQPKYAAELAENRGKNRYNNVLPYDISRVKLSVQTHSTDDYINANYMPGYHSKKDFIATQGPLPNTLKDFWRMVWEKNVYAIIMLTKCVEQGRTKCEEYWPSKQAQDYGDITVAMTSEIVLPEVVTIRDFTVKNIQTSESHPLRQFHFTSWPDHGVPDTTDLLINFRYLVRDYMKQSPPESPILVHCSAGVGRTGTFIAIDRLIYQIENENTVDVYGIVYDLRMHRPLMVQTEDQYVFLNQCVLDIVRSQKDSKVDLIYQNTTAMTIYENLAPVTTFGKTNGYIA

SEQ ID NO: 1194 - protein, 21 aa, Homo sapiens
AVFGCIFGALVIVTVGGFIFW

SEQ ID NO: 1195 - protein, 185 aa, Homo sapiens
KEITNALETWGALGQDINLDIPSFQMSDDIDDIKWEKTSDKKKIAQFRKEKETFKEKDTYKLFKNGTLKIKHLKTDDQDIYKVSIYDTKGKNVLEKIFDLKIQERVSKPKISWTCINTTLTCEVMNGTDPELNLYQDGKHLKLSQRVITHKWTTSLSAKFKCTAGNKVSKESSVEPVSCPEKGLD

SEQ ID NO: 1196 - protein, 106 aa, Homo sapiens
IEVMYPPPYLDNEKSNGTITHVKGKHLCPSPLFPGPSKPFWVLVVVGGVLACYSLLVTVAHIFWVRSKRSRLLHSDYMNMTPRRPGPTRKHYQPYAPPRDFAAYRS

SEQ ID NO: 1197 - protein, 66 aa, Homo sapiens
IEVMYPPPYLDNEKSNGTIIHVKGKHLCPSPLFPGPSKPFWVLVVVGGVLACYSLLVTVAFIIFWV

SEQ ID NO: 1198 - protein, 33 aa, Homo sapiens
IFWVLVVVGGVLACYSLLVTVAFIIFWVRSKRR

SEQ ID NO: 1199 - protein, 68 aa, Homo sapiens; identical to SEQ ID NO: 381

SEQ ID NO: 1200 - protein, 28 aa, Homo sapiens
MFWVLVVVGGVLACYSLLVTVAFIIFWV

SEQ ID NO: 1201 - protein, 26 aa, Homo sapiens
FWVLVVVGGVLACYSLLVTVAFHFWV

SEQ ID NO: 1202 - protein, 68 aa, Homo sapiens
FWVLVVVGGVLACYSLLVTVAFIIFWVRSKRSRLLHSDYMNMTPRRPGPTRKHYQAYAAARDFAAYRS

SEQ ID NO: 1203 - protein, 106 aa, Homo sapiens
IEVMYPPPYLDNEKSNGTIIHVKGKHLCPSPLFPGPSKPFWVLWVGGVLACYSLLVTVAFIIFWVRSKRSRLLHSDYMNMTPRRPGPTRKHYQPYAPPRDFAAYRS

SEQ ID NO: 1204 - protein, 28 aa, Homo sapiens
MFWVLVVVGGVLACYSGGVTVAFIIFWV

SEQ ID NO: 1205 - protein, 26 aa, Homo sapiens
WVLVVVGGVLACYSLLVTVAFIIFWV

SEQ ID NO: 1206 - protein, 28 aa, Homo sapiens
FWVLVVVGGVLACYSLLVTVAFIIFWVR

SEQ ID NO: 1207 - protein, 69 aa, Homo sapiens
PFWVLVVVGGVLACYSLLVTVAFIIFWVRSKRSRLLHSDYMNMTPRRPGPTRKHYQPYAPPRDFAAYRS

SEQ ID NO: 1208 - protein, 180 aa, Homo sapiens
FWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1209 - protein, 216 aa, Homo sapiens
FWVLVVVGGVLACYSLLVTVAFIIFWVRSKRSRLLHSDYMNMTPRRPGPTRKHYQPYAPPRDFAAYRSRDQRLPPDAHKPPGGGSFRTPIQEEQADAHSTLAKIRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1210 - protein, 140 aa, Homo sapiens
FWVLVVVGGVLACYSLLVTVAFIIFWVRRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1211 - protein, 23 aa, Homo sapiens
LCYLLDGILFIYGVILTALFLRV

SEQ ID NO: 1212 - protein, 51 aa, Homo sapiens
MKWKALFTAAILQAQLPITEAQSFGLLDPKLCYLLDGILFIYGVILTALFL

SEQ ID NO: 1213 - protein, 21 aa, Homo sapiens
LCYLLDGILFIYGVILTALFL

SEQ ID NO: 1214 - protein, 25 aa, Homo sapiens
ALIVLGGVAGLLLFIGLGIFFCVRC

SEQ ID NO: 1215 - protein, 22 aa, Homo sapiens
MALIVLGGVAGLLLFIGLGIFF

SEQ ID NO: 1216 - protein, 725 aa, Homo sapiens
ALIAFLAFLIIVTSIALLVVLYKIYDLHKKRSCNLDEQQELVERDDEKQLMNVEPIHADILLETYKRKIADEGRLFLAEFQSIPRVFSKFPIKEARKPFNQNKNRYVDILPYDYNRVELSEINGDAGSNYINASYIDGFKEPRKYIAAQGPRDETVDDFWRMIWEQKATVIVMVTRCEEGNRNKCAEYWPSMEEGTRAFGDVVVKINQHKRCPDYIIQKLNIVNKKEKATGREVTHIQFTSWPDHGVPEDPHLLLKLRRRVNAFSNFFSGPIWHCSAGVGRTGTYIGIDAMLEGLEAENKVDVYGYVVKLRRQRCLMVQVEAQYILIHQALVEYNQFGETEVNLSELHPYLHNMKKRDPPSEPSPLEAEFQRLPSYRSWRTQHIGNQEENKSKNRNSNVIPYDYNRVPLKHELEMSKESEHDSDESSDDDSDSEEPSKYINASFIMSYWKPEVMIAAQGPLKETIGDFWQMIFQRKVKVIVMLTELKHGDQEICAQYWGEGKQTYGDIEVDLKDTDKSSTYTLRVFELRHSKRKDSRTVYQYQYTNWSVEQLPAEPKELISMIQWKQKLPQKNSSEGNKHHKSTPLLIHCRDGSQQTGIFCALLNLLESAETEEWDIFQWKALRKARPGMVSTFEQYQFLYDVIASTYPAQNGQVKKNNHQEDKIEFDNEVDKVKQDANCVNPLGAPEKLPEAKEQAEGSEPTSGTEGPEHSVNGPASPALNQGS

SEQ ID NO: 1217 - protein, 23 aa, Homo sapiens
PLFIPVAVMVTAFSGLAFIIWLA

SEQ ID NO: 1218 - protein, 24 aa, Homo sapiens
ALPAALAVISFLLGLGLGVACVLA

SEQ ID NO: 1219 - protein, 21 aa, Homo sapiens
MALPVTALLLPLALLLHAARP

SEQ ID NO: 1220 - protein, 286 aa, Homo sapiens
AAAFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1221 - protein, 226 aa, Homo sapiens
AAATTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1222 - protein, 83 aa, Homo sapiens
FVPVFLPAKPTTTPAPRPPTPAPTIASQPLSLRPEACRPAAGGAVHTRGLDFACDIYIWAPLAGTCGVLLLSLVITLYCNHRN

SEQ ID NO: 1223 - protein, 22 aa, Homo sapiens
IWAPLAGTCGVLLLSLVITLYC

SEQ ID NO: 1224 - protein, 24 aa, Homo sapiens
IYIWAPLAGTCGVLLLSLVITLYC

SEQ ID NO: 1225 - DNA, 72 bp, Artificial Sequence
  source: /note="Description of Artificial Sequence: Synthetic Construct"
atctatatctgggcaccactggcaggaacatgtggcgtgctgctgctgtccctggtcatcaccctgtattgc

SEQ ID NO: 1226 - DNA, 72 bp, Artificial Sequence
  source: /note="Description of Artificial Sequence: Synthetic Construct"
atctacatctgggcaccactggcaggaacatgcggcgtgctgctgctgtccctggtcatcaccctgtattgt

SEQ ID NO: 1227 - DNA, 72 bp, Artificial Sequence
  source: /note="Description of Artificial Sequence: Synthetic Construct"
atctacatctgggcacctctggcaggaacatgcggcgtgctgctgctgtctctggtcatcaccctgtattgt

SEQ ID NO: 1228 - DNA, 72 bp, Artificial Sequence
  source: /note="Description of Artificial Sequence: Synthetic oligonucleotide"
atctacatctgggcgcccttggccgggacttgtggggtccttctcctgtcactggttatcaccctttactgc

SEQ ID NO: 1229 - DNA, 72 bp, Artificial Sequence
  source: /note="Description of Artificial Sequence: Synthetic oligonucleotide"
atctacatttgggcccctctggctggtacttgcggggtcctgctgctttcactcgtgatcactctttactgt

SEQ ID NO: 1230 - protein, 25 aa, Homo sapiens
IYIWAPLAGTCGVLLLSLVITLYCR

SEQ ID NO: 1231 - protein, 71 aa, Homo sapiens
PTTTPAPRPPTPAPTIASQPLSLRPEACRPAAGGAVHTRGLDFACDIYIWAPLAGTCGVLLLSLVITLYCN

SEQ ID NO: 1232 - protein, 25 aa, Homo sapiens
IYIWAPLAGTCGVLLLSLVITLVCR

SEQ ID NO: 1233 - protein, 21 aa, Homo sapiens
IYIWAPLAGTCGVLLLSLVIT

SEQ ID NO: 1234 - protein, 23 aa, Homo sapiens
IYIWAPLAGTCGVLLLSLVITLY

SEQ ID NO: 1235 - protein, 23 aa, Homo sapiens
LGLLVAGVLVLLVSLGVAIHLCC

SEQ ID NO: 1236 - protein, 73 aa, Homo sapiens
TPAPRPPTPAPTIASQPLSLRPEACRPAAGGAWTRGLDFACDIYIWAPLAGTCGVLLLSLVITLYCNHRNRRR

SEQ ID NO: 1237 - protein, 27 aa, Homo sapiens
ILLAGLVAADAVASLLIVGAVFLCARR

SEQ ID NO: 1238 - protein, 52 aa, Homo sapiens
FFIPLLVVILFAVDTGLFISTQQQVTFLLKIKRTRKGFRLLNPHPKPNPKNN

SEQ ID NO: 1239 - protein, 257 aa, Homo sapiens
MAPAMESPTLLCVALLFFAPDGVLAVPQKPKVSLNPPWNRIFKGENVTLTCNGNNFFEVSSTKWFHNGSLSEETNSSLNIVNAKFEDSGEYKCQHQQVNESEPVYLEVFSDWLLLQASAEVVMEGQPLFLRCHGWRNWDVYKVIYYKDGEALKYWYENHNISITNATVEDSGTYYCTGKVWQLDYESEPLNITVIKAPREKYWLQFFIPLLVVILFAVDTGLFISTQQQVTFLLKIKRTRKGFRLLNPHPKPNPKNN

SEQ ID NO: 1240 - protein, 54 aa, Homo sapiens
DIFIPLLVVILFAVDTGLFISTQQQVTFLLKIKRTRKGFRLLNPHPKPNPKNNR

SEQ ID NO: 1241 - protein, 31 aa, Homo sapiens
PLGWLTVVLLAVAACVLLLTSAQLGLHIWQL

SEQ ID NO: 1242 - protein, 24 aa, Homo sapiens
SIISAVVGILLVVVLGVVFGILII

SEQ ID NO: 1243 - protein, 113 aa, Homo sapiens
CHPECQPQNGSVTCFGPEADQCVACAHYKDPPFCVARCPSGVKPDLSYMPIWKFPDEEGACQPCPINCTHSCVDLDDKGCPAEQRASPLTSIISAVVGILLVVVLGVVFGILI

SEQ ID NO: 1244 - protein, 21 aa, Homo sapiens
FWLPIGCAAFVVVCILGCILI

SEQ ID NO: 1245 - protein, 233 aa, Homo sapiens
EPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKKD

SEQ ID NO: 1246 - protein, 21 aa, Homo sapiens
VAAILGLGLVLGLLGPLAILL

SEQ ID NO: 1247 - protein, 244 aa, Homo sapiens
MDTESNRRANLALPQEPSSVPAFEVLEISPQEVSSGRLLKSASSPPLHTWLTVLKKEQEFLGVTQILTAMICLCFGTVVCSVLDISHIEGDIFSSFKAGYPFWGAIFFSISGMLSIISERRNATYLVRGSLGANTASSIAGGTGITILIINLKKSLAYIHIHSCQKFFETKCFMASFSTEIVVMMLFLTILGLGSAVSLTICGAGEELKGNKVPEDRVYEELNIYSATYSELEDPGEMSPPIDL

SEQ ID NO: 1248 - protein, 21 aa, Homo sapiens
LLFLILGVLSLLLLVTGAFGF

SEQ ID NO: 1249 - protein, 20 aa, Homo sapiens
VGWGGLLGSLVLLVWVLAVI

SEQ ID NO: 1250 - protein, 27 aa, Homo sapiens
FWALVVVAGVLFCYGLLVTVALCVIWT

SEQ ID NO: 1251 - protein, 107 aa, Homo sapiens
IEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRS

SEQ ID NO: 1252 - protein, 65 aa, Homo sapiens
VMYPPPYLDNEKSNGTIIHVKGKHLCPSPLFPGPSKPFWVLVVVGGVLACYSLLVTVAFIIFWVR

SEQ ID NO: 1253 - protein, 101 aa, Homo sapiens
APVGLVARLADESGHVVLRWLPPPETPMTSHIRYEVDVSAGNGAGSVQRVEILEGRTECVLSNLRGRTRYTFAVRARMAEPSFGGFWSAWSEPVSLLTPSD

SEQ ID NO: 1254 - protein, 68 aa, Homo sapiens
TTPAPRPPTPAPTIASQPLSLRPEACRPAAGGAVHTRGLDFACDIYIWAPLAGTCGVLLLSLVITLYC

SEQ ID NO: 1255 - protein, 243 aa, Homo sapiens
DIQMTQSSSYLSVSLGGRVTITCKASDHINNWLAWYQQKPGNAPRLLISGATSLETGVPSRFSGSGSGKDYTLSITSLQTEDVATYYCQQYWSTPFTFGSGTKLEIKGGGGSGGGGSGGGGSQVQLKESGPGLVAPSQSLSITSTVSGFSLSRYSVHWVRQPPGKGLEWLGMIWGGGSTDYNSALKSRLSISKDNSKSQVFLKMNSLQTDDTAMYYCARNEGDTTAGTWFAYWGQGTLVTVSS

SEQ ID NO: 1256 - protein, 62 aa, Homo sapiens
ALSNSIMYFSHFVPVFLPAKPTTTPAPRPPTPAPTIASQPLSLRPEACRPAAGGAVHTRGLD

SEQ ID NO: 1257 - protein, 68 aa, Homo sapiens
TTTPAPRPPTPAPTIASQPLSLRPEACRPAAGGAVHTRGLDFACDIYIWAPLAGTCGVLLLSLVITLY

SEQ ID NO: 1258 - protein, 70 aa, Homo sapiens
KPTTTPAPRPPTPAPTIASQPLSLRPEACRPAAGGAVHTRGLDFACDIYIWAPLAGTCGVLLLSLVITLY

SEQ ID NO: 1259 - protein, 42 aa, Homo sapiens
KRGRKKLLYIFKQPFMRPVQTTQEEDGCSCRFPEEEEGGCEL

SEQ ID NO: 1260 - DNA, 126 bp, Artificial Sequence
  source: /note="Description of Artificial Sequence: Synthetic Domain"
aagagaggccggaagaagctgctgtacatcttcaagcagcccttcatgaggcccgtgcagacaacccaggaggaggacggctgcagctgtcggttcccagaggaggaggagggaggatgtgagctg

SEQ ID NO: 1261 - DNA, 126 bp, Artificial Sequence
  source: /note="Description of Artificial Sequence: Synthetic Domain"
aagcgcggcaggaagaagctgctgtacatcttcaagcagccctttatgcgccctgtgcagacaacccaggaggaggacggctgcagctgtaggttcccagaggaggaggagggaggatgtgagctg

SEQ ID NO: 1262 - DNA, 126 bp, Artificial Sequence
  source: /note="Description of Artificial Sequence: Synthetic Domain"
aagcgcggcaggaagaagctgctgtacatcttcaagcagccttttatgcgcccagtgcagacaacccaggaggaggacggctgcagctgtaggttccctgaggaggaggagggaggatgtgagctg

SEQ ID NO: 1263 - DNA, 126 bp, Artificial Sequence
  source: /note="Description of Artificial Sequence: Synthetic Domain"
aagcgcggcaggaagaagctgctgtacatcttcaagcagccctttatgcgccctgtgcagacaacccaggaggaggacggctgcagctgtaggttccctgaggaggaggagggaggatgtgagctg

SEQ ID NO: 1264 - DNA, 126 bp, Artificial Sequence
  source: /note="Description of Artificial Sequence: Synthetic Domain"
aagcgcggcaggaagaagctgctgtacatcttcaagcagccttttatgcgcccagtgcagacaacccaggaggaggacggctgcagctgtaggttccctgaggaggaggagggaggatgcgagctg

SEQ ID NO: 1265 - DNA, 126 bp, Artificial Sequence
  source: /note="Description of Artificial Sequence: Synthetic Domain"
aagcgcggccggaagaagctgctgtatatcttcaagcagcccttcatgcggcccgtgcagacaacccaggaggaggacggctgcagctgtaggttccctgaggaggaggagggcggctgtgagctg

SEQ ID NO: 1266 - DNA, 126 bp, Artificial Sequence
  source: /note="Description of Artificial Sequence: Synthetic polynucleotide"
aaacggggcagaaagaaactcctgtatatattcaaacaaccatttatgagaccagtacaaactactcaagaggaagatggctgtagctgccgatttccagaagaagaagaaggaggatgtgaactg

SEQ ID NO: 1267 - DNA, 126 bp, Artificial Sequence
  source: /note="Description of Artificial Sequence: Synthetic polynucleotide"
aagcgcggtcggaagaagctgctgtacatctttaagcaacccttcatgaggcctgtgcagactactcaagaggaggacggctgttcatgccggttcccagaggaggaggaaggcggctgcgaactg

SEQ ID NO: 1268 - protein, 35 aa, Homo sapiens
TKKKYSSSVHDPNGEYMFMRAVNTAKKSRLTDVTL

SEQ ID NO: 1269 - protein, 27 aa, Homo sapiens
FWVLVVVGGVLACYSLLVTVAFIIFWV

SEQ ID NO: 1270 - protein, 86 aa, Homo sapiens
MIPAVVLLLLLLVEQAAALGEPQLCYILDAILFLYGIVLTLLYCRLKIQVRKAAITSYEKSDGVYTGLSTRNQETYETLKHEKPPQ

SEQ ID NO: 1271 - protein, 222 aa, Homo sapiens
AAAIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1272 - protein, 705 aa, Artificial Sequence
  source: /note="Description of Artificial Sequence: Synthetic Chimeric Antigen Receptor sequence"
ADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRRAEGRGSLLTCGDVEENPGPMAVPTQVLGLLLLWLTDARCDIQMTQSPSSLSASVGDRVTITCRASEDIYFNLVWYQQKPGKAPKLLIYDTNRLADGVPSRFSGSGSGTQYTLTISSLQPEDFATYYCQHYKNYPLTFGQGTKLEIKRSGGGGSGGGGSGGGGSRSEVQLVESGGGLVQPGGSLRLSCAASGFTLSNYGMHWIRQAPGKGLEWVSSISLNGGSTYYRDSVKGRFTISRDNAKSTLYLQMNSLRAEDTAVYYCAAQDAYTGGYFDYWGQGTLVTVSSMPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKMALIVLGGVAGLLLFIGLGIFFMALIVLGGVAGLLLFIGLGIFFCVRCRHRRRSGGGGSAQLEKKLQALKKKNAQLKWKLQALKKKLAQ

SEQ ID NO: 1273 - protein, 482 aa, Artificial Sequence
  source: /note="Description of Artificial Sequence: Synthetic Chimeric Antigen Receptor sequence"
MALPVTALLLPLALLLHAARPEVQLLETGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSSASGGGGSGGRASGGGGSEIVLTQSPATLSVSPGESATLSCRASQSVSSNLAWYQQKPGQAPRLLIYGASTRASGIPDRFSGSGSGTDFTLTISSLQAEDVAVYYCQQYGSSLTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1274 - protein, 222 aa, Artificial Sequence; identical to SEQ ID NO: 1271
  source: /note="Description of Artificial Sequence: Synthetic Chimeric Antigen Receptor sequence"

SEQ ID NO: 1275 - protein, 226 aa, Artificial Sequence; identical to SEQ ID NO: 1221
  source: /note="Description of Artificial Sequence: Synthetic Chimeric Antigen Receptor sequence"

SEQ ID NO: 1276 - protein, 286 aa, Artificial Sequence; identical to SEQ ID NO: 1220
  source: /note="Description of Artificial Sequence: Synthetic Chimeric Antigen Receptor sequence"

SEQ ID NO: 1277 - protein, 487 aa, Artificial Sequence
  source: /note="Description of Artificial Sequence: Synthetic Chimeric Antigen Receptor sequence"
LLVTSLLLCELPHPAFLLIPDTALQLQQSGAELVRPGASVTLSCKASGYTFTDYEMHWVKQTPVHGLEWIGAIDPETGGTAYNQKFEGKAILTADKSSSTAYMELRSLTSEDSPVYYCARRRYYGSSSFDYWGQGTTLTVSSGGGGSGGGGSGGGGSDVQMIQTPSSLSASLGDRVTISCRASQDIGNYLNWYQQKPDGTVKLLIYYTSRLHSGVPSRFSGSGSGTEYSLTISNLEQEDIATYFCQQGSALPPTFGGGTKLEINRAAAIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1278 - protein, 487 aa, Artificial Sequence
  source: /note="Description of Artificial Sequence: Synthetic Chimeric Antigen Receptor sequence"
LLVTSLLLCELPHPAFLLIPDTQVQLQQSGAEVKKPGSSVKVSCKASGYTFTDYEISWVRQAPGQGLEWMGGIDPETGGTNYAQKFQGRVTITADESTSTAYMELSSLRSEDTAVYYCARRRYYGSSSFDYWWGQGTMVTVSSGGGGSGGGGSGGGGSEIVLTQSPATLSLSPGERATLSCRASQDIGNYAWYQQKPGQAPRLLIYYTSRATGIPARFSGSGSGTDFTLTISSLEPEDFAVYYCQQGSALPPTFFGQGTKLEIKRAAAIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1279 - protein, 489 aa, Artificial Sequence
  source: /note="Description of Artificial Sequence: Synthetic Chimeric Antigen Receptor sequence"
LLVTSLLLCELPHPAFLLIPDTDVQLQESGPVLVKTGASVKMSCTASGYTFTDHFMDWVKQSHGKSLEWIGSLNPYSGGTSYNQKFKGKATLTVDKSSSTAYMELNSLTSVDSAVYYCARHNWGAYFDYWGQGTTLTVSSGGGGSGGGGSGGGGSDIVMTQAAPSVPVTPGESVSISCRSSKSLLHSNGNTYLYWFLQRPGQSPQRLIYYMSNLASGVPDRFSGRGSGTDFTLRISRVEAEDVGVYYCMQGLEDPYTFGGGTKLEIKAAAIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1280 - protein, 490 aa, Artificial Sequence
  source: /note="Description of Artificial Sequence: Synthetic Chimeric Antigen Receptor sequence"
LLVTSLLLCELPHPAFLLIPDTDVKLQESGPGLVAPSQSLSITCTVSGFSLTSYAVSWVRQPPGKGLEWLGIIWSGGATNYNSALKSRLSISKDNSKSQVFLKMNGLQTDDTARYYCAREHYYGSSAMDYWGQGASITVSSGGGGSGGGGSGGGGSGIVMTQSPLSLPVSLGDQASISCRSSQSIVHSYGNTYLFWYLQKPGQSPKLLIYRVSNRFSGVPDRFSGSGSGTNFTLKISRVEAEDMGVYYCFQGTHVPYTFGGGTKLEIKAAAIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1281 - protein, 490 aa, Artificial Sequence
  source: /note="Description of Artificial Sequence: Synthetic Chimeric Antigen Receptor sequence"
LLVTSLLLCELPHPAFLLIPDTQVQLQQSGAEVKKPGSSVKVSCKASGYTFTDHFISWVRQAPGQGLEWMGGLNPYSGGTNYAQKFQGRVTITADESTSTAYMELSSLRSEDTAVYYCARHNWGAYFDYWWGQGTMVTVSSGGGGSGGGGSGGGGSEIVLTQSPATLSLSPGERATLSCRASKSLLHSNGNTYAWYQQKPGQAPRLLIYYMSRATGIPARFSGSGSGTDFTLTISSLEPEDFAVYYCMQGLEDPYTFFGQGTKLEIKRAAAIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1282 - protein, 491 aa, Artificial Sequence
  source: /note="Description of Artificial Sequence: Synthetic Chimeric Antigen Receptor sequence"
LLVTSLLLCELPHPAFLLIPDTALQLQQSGAELVRPGASVTLSCKASGYTFTDYEMHWVKQTPVHGLEWIGAIDPETGGTAYNQKFEGKAILTADKSSSTAYMELRSLTSEDSPVYYCARRRYYGSSSFDYWGQGTTLTVSSGGGGSGGGGSGGGGSDVQMIQTPSSLSASLGDRVTISCRASQDIGNYLNWYQQKPDGTVKLLIYYTSRLHSGVPSRFSGSGSGTEYSLTISNLEQEDIATYFCQQGSALPPTFGGGTKLEINRAAATTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1283 - protein, 491 aa, Artificial Sequence
  source: /note="Description of Artificial Sequence: Synthetic Chimeric Antigen Receptor sequence"
LLVTSLLLCELPHPAFLLIPDTQVQLQQSGAELVKPGASVKISCKASGYAFSSYWMNWVKQRPGKGLEWIGQIYPGDGDTTYNGKFKGKATLTADKSSSTVYMQLNSLTSEDSAVYFCVRYYYGSSGYFDYWGQGTTLTVSSGGGGSGGGGSGGGGSDVQMIQTPDSLAVSLGQRATISCRASESVDNYGISFMHWYQQKPGQSPKLLIYRASNLESGIPARFSGSGSRTDFTLTINPVETDDVATYYCQQNNKDPPTFGGGTKLEIKRAAAIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1284 - protein, 491 aa, Artificial Sequence
  source: /note="Description of Artificial Sequence: Synthetic Chimeric Antigen Receptor sequence"
LLVTSLLLCELPHPAFLLIPDTQVQLQQSGAEVKKPGSSVKVSCKASGYAFSSYISWVRQAPGQGLEWMGGQIYPGDGDTNYAQKFQGRVTITADESTSTAYMELSSLRSEDTAVYYCVRYYYGSSGYFDYWWGQGTMVTVSSGGGGSGGGGSGGGGSEIVLTQSPATLSLSPGERATLSCRASESVDNYGISFAWYQQKPGQAPRLLIYRASRATGIPARFSGSGSGTDFTLTISSLEPEDFAVYYCQQNNKDPPTFFGQGTKLEIKRAAAIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1285 - protein, 491 aa, Artificial Sequence
  source: /note="Description of Artificial Sequence: Synthetic Chimeric Antigen Receptor sequence"
LLVTSLLLCELPHPAFLLIPDTQVQLQQSGAEVKKPGSSVKVSCKASGYTFTDYEISWVRQAPGQGLEWMGGIDPETGGTNYAQKFQGRVTITADESTSTAYMELSSLRSEDTAVYYCARRRYYGSSSFDYWWGQGTMVTVSSGGGGSGGGGSGGGGSEIVLTQSPATLSLSPGERATLSCRASQDIGNYAWYQQKPGQAPRLLIYYTSRATGIPARFSGSGSGTDFTLTISSLEPEDFAVYYCQQGSALPPTFFGQGTKLEIKRAAATTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1286 - protein, 492 aa, Artificial Sequence
  source: /note="Description of Artificial Sequence: Synthetic Chimeric Antigen Receptor sequence"
LLVTSLLLCELPHPAFLLIPDTQVQLQQSGAEVKKPGSSVKVSCKASGFSLTSYAISWVRQAPGQGLEWMGGIIWSGGATNYAQKFQGRVTITADESTSTAYMELSSLRSEDTAVYYCAREHYYGSSAMDYWWGQGTMVTVSSGGGGSGGGGSGGGGSEIVLTQSPATLSLSPGERATLSCRASQSIVHSYGNTYAWYQQKPGQAPRLLIYRVSRATGIPARFSGSGSGTDFTLTISSLEPEDFAVYYCFQGTHVPYTFFGQGTKLEIKRAAAIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1287 - protein, 493 aa, Artificial Sequence
  source: /note="Description of Artificial Sequence: Synthetic Chimeric Antigen Receptor sequence"
LLVTSLLLCELPHPAFLLIPDTDVQLQESGPVLVKTGASVKMSCTASGYTFTDHFMDWVKQSHGKSLEWIGSLNPYSGGTSYNQKFKGKATLTVDKSSSTAYMELNSLTSVDSAVYYCARHNWGAYFDYWGQGTTLTVSSGGGGSGGGGSGGGGSDIVMTQAAPSVPVTPGESVSISCRSSKSLLHSNGNTYLYWFLQRPGQSPQRLIYYMSNLASGVPDRFSGRGSGTDFTLRISRVEAEDVGVYYCMQGLEDPYTFGGGTKLEIKAAATTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1288 - protein, 493 aa, Artificial Sequence
  source: /note="Description of Artificial Sequence: Synthetic Chimeric Antigen Receptor sequence"
MALPVTALLLPLALLLHAARPDIVLTQSPPSLAMSLGKRATISCRASESVTILGSHLIHWYQQKPGQPPTLLIQLASNVQTGVPARFSGSGSRTDFTLTIDPVEEDDVAVYYCLQSRTIPRTFGGGTKLEIKGSTSGSGKPGSGEGSTKGQIQLVQSGPELKKPGETVKISCKASGYTFTDYSINWVKRAPGKGLKWMGWINTETREPAYAYDFRGRFAFSLETSASTAYLQINNLKYEDTATYFCALDYSYAMDYWGQGTSVTVSSAAATTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1289 - protein, 494 aa, Artificial Sequence
  source: /note="Description of Artificial Sequence: Synthetic Chimeric Antigen Receptor sequence"
LLVTSLLLCELPHPAFLLIPDTDVKLQESGPGLVAPSQSLSITCTVSGFSLTSYAVSWVRQPPGKGLEWLGIIWSGGATNYNSALKSRLSISKDNSKSQVFLKMNGLQTDDTARYYCAREHYYGSSAMDYWGQGASITVSSGGGGSGGGGSGGGGSGIVMTQSPLSLPVSLGDQASISCRSSQSIVHSYGNTYLFWYLQKPGQSPKLLIYRVSNRFSGVPDRFSGSGSGTNFTLKISRVEAEDMGVYYCFQGTHVPYTFGGGTKLEIKAAATTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1290 - protein, 494 aa, Artificial Sequence
  source: /note="Description of Artificial Sequence: Synthetic Chimeric Antigen Receptor sequence"
LLVTSLLLCELPHPAFLLIPDTQVQLQQSGAEVKKPGSSVKVSCKASGYTFTDHFISWVRQAPGQGLEWMGGLNPYSGGTNYAQKFQGRVTITADESTSTAYMELSSLRSEDTAVYYCARHNWGAYFDYWWGQGTMVTVSSGGGGSGGGGSGGGGSEIVLTQSPATLSLSPGERATLSCRASKSLLHSNGNTYAWYQQKPGQAPRLLIYYMSRATGIPARFSGSGSGTDFTLTISSLEPEDFAVYYCMQGLEDPYTFFGQGTKLEIKRAAATTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1291 - protein, 495 aa, Artificial Sequence
  source: /note="Description of Artificial Sequence: Synthetic Chimeric Antigen Receptor sequence"
LLVTSLLLCELPHPAFLLIPDTQVQLQQSGAELVKPGASVKISCKASGYAFSSYWMNWVKQRPGKGLEWIGQIYPGDGDTTYNGKFKGKATLTADKSSSTVYMQLNSLTSEDSAVYFCVRYYYGSSGYFDYWGQGTTLTVSSGGGGSGGGGSGGGGSDVQMIQTPDSLAVSLGQRATISCRASESVDNYGISFMHWYQQKPGQSPKLLIYRASNLESGIPARFSGSGSRTDFTLTINPVETDDVATYYCQQNNKDPPTFGGGTKLEIKRAAATTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1292 - protein, 495 aa, Artificial Sequence
  source: /note="Description of Artificial Sequence: Synthetic Chimeric Antigen Receptor sequence"
LLVTSLLLCELPHPAFLLIPDTQVQLQQSGAEVKKPGSSVKVSCKASGYAFSSYISWVRQAPGQGLEWMGGQIYPGDGDTNYAQKFQGRVTITADESTSTAYMELSSLRSEDTAVYYCVRYYYGSSGYFDYWWGQGTMVTVSSGGGGSGGGGSGGGGSEIVLTQSPATLSLSPGERATLSCRASESVDNYGISFAWYQQKPGQAPRLLIYRASRATGIPARFSGSGSGTDFTLTISSLEPEDFAVYYCQQNNKDPPTFFGQGTKLEIKRAAATTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1293 - protein, 496 aa, Artificial Sequence
  source: /note="Description of Artificial Sequence: Synthetic Chimeric Antigen Receptor sequence"
LLVTSLLLCELPHPAFLLIPDTQVQLQQSGAEVKKPGSSVKVSCKASGFSLTSYAISWVRQAPGQGLEWMGGIIWSGGATNYAQKFQGRVTITADESTSTAYMELSSLRSEDTAVYYCAREHYYGSSAMDYWWGQGTMVTVSSGGGGSGGGGSGGGGSEIVLTQSPATLSLSPGERATLSCRASQSIVHSYGNTYAWYQQKPGQAPRLLIYRVSRATGIPARFSGSGSGTDFTLTISSLEPEDFAVYYCFQGTHVPYTFFGQGTKLEIKRAAATTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1294 - protein, 551 aa, Artificial Sequence
  source: /note="Description of Artificial Sequence: Synthetic Chimeric Antigen Receptor sequence"
LLVTSLLLCELPHPAFLLIPDTALQLQQSGAELVRPGASVTLSCKASGYTFTDYEMHWVKQTPVHGLEWIGAIDPETGGTAYNQKFEGKAILTADKSSSTAYMELRSLTSEDSPVYYCARRRYYGSSSFDYWGQGTTLTVSSGGGGSGGGGSGGGGSDVQMIQTPSSLSASLGDRVTISCRASQDIGNYLNWYQQKPDGTVKLLIYYTSRLHSGVPSRFSGSGSGTEYSLTISNLEQEDIATYFCQQGSALPPTFGGGTKLEINRAAAFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1295 - protein, 551 aa, Artificial Sequence
  source: /note="Description of Artificial Sequence: Synthetic Chimeric Antigen Receptor sequence"
LLVTSLLLCELPHPAFLLIPDTQVQLQQSGAEVKKPGSSVKVSCKASGYTFTDYEISWVRQAPGQGLEWMGGIDPETGGTNYAQKFQGRVTITADESTSTAYMELSSLRSEDTAVYYCARRRYYGSSSFDYWWGQGTMVTVSSGGGGSGGGGSGGGGSEIVLTQSPATLSLSPGERATLSCRASQDIGNYAWYQQKPGQAPRLLIYYTSRATGIPARFSGSGSGTDFTLTISSLEPEDFAVYYCQQGSALPPTFFGQGTKLEIKRAAAFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1296 - protein, 553 aa, Artificial Sequence
  source: /note="Description of Artificial Sequence: Synthetic Chimeric Antigen Receptor sequence"
LLVTSLLLCELPHPAFLLIPDTDVQLQESGPVLVKTGASVKMSCTASGYTFTDHFMDWVKQSHGKSLEWIGSLNPYSGGTSYNQKFKGKATLTVDKSSSTAYMELNSLTSVDSAVYYCARHNWGAYFDYWGQGTTLTVSSGGGGSGGGGSGGGGSDIVMTQAAPSVPVTPGESVSISCRSSKSLLHSNGNTYLYWFLQRPGQSPQRLIYYMSNLASGVPDRFSGRGSGTDFTLRISRVEAEDVGVYYCMQGLEDPYTFGGGTKLEIKAAAFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1297 - protein, 554 aa, Artificial Sequence
  source: /note="Description of Artificial Sequence: Synthetic Chimeric Antigen Receptor sequence"
LLVTSLLLCELPHPAFLLIPDTDVKLQESGPGLVAPSQSLSITCTVSGFSLTSYAVSWVRQPPGKGLEWLGIIWSGGATNYNSALKSRLSISKDNSKSQVFLKMNGLQTDDTARYYCAREHYYGSSAMDYWGQGASITVSSGGGGSGGGGSGGGGSGIVMTQSPLSLPVSLGDQASISCRSSQSIVHSYGNTYLFWYLQKPGQSPKLLIYRVSNRFSGVPDRFSGSGSGTNFTLKISRVEAEDMGVYYCFQGTHVPYTFGGGTKLEIKAAAFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1298 - protein, 554 aa, Artificial Sequence
  source: /note="Description of Artificial Sequence: Synthetic Chimeric Antigen Receptor sequence"
LLVTSLLLCELPHPAFLLIPDTQVQLQQSGAEVKKPGSSVKVSCKASGYTFTDHFISWVRQAPGQGLEWMGGLNPYSGGTNYAQKFQGRVTITADESTSTAYMELSSLRSEDTAVYYCARHNWGAYFDYWWGQGTMVTVSSGGGGSGGGGSGGGGSEIVLTQSPATLSLSPGERATLSCRASKSLLHSNGNTYAWYQQKPGQAPRLLIYYMSRATGIPARFSGSGSGTDFTLTISSLEPEDFAVYYCMQGLEDPYTFFGQGTKLEIKRAAAFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1299 - protein, 555 aa, Artificial Sequence
  source: /note="Description of Artificial Sequence: Synthetic Chimeric Antigen Receptor sequence"
LLVTSLLLCELPHPAFLLIPDTQVQLQQSGAELVKPGASVKISCKASGYAFSSYWMNWVKQRPGKGLEWIGQIYPGDGDTTYNGKFKGKATLTADKSSSTVYMQLNSLTSEDSAVYFCVRYYYGSSGYFDYWGQGTTLTVSSGGGGSGGGGSGGGGSDVQMIQTPDSLAVSLGQRATISCRASESVDNYGISFMHWYQQKPGQSPKLLIYRASNLESGIPARFSGSGSRTDFTLTINPVETDDVATYYCQQNNKDPPTFGGGTKLEIKRAAAFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1300 - protein, 555 aa, Artificial Sequence
  source: /note="Description of Artificial Sequence: Synthetic Chimeric Antigen Receptor sequence"
LLVTSLLLCELPHPAFLLIPDTQVQLQQSGAEVKKPGSSVKVSCKASGYAFSSYISWVRQAPGQGLEWMGGQIYPGDGDTNYAQKFQGRVTITADESTSTAYMELSSLRSEDTAVYYCVRYYYGSSGYFDYWWGQGTMVTVSSGGGGSGGGGSGGGGSEIVLTQSPATLSLSPGERATLSCRASESVDNYGISFAWYQQKPGQAPRLLIYRASRATGIPARFSGSGSGTDFTLTISSLEPEDFAVYYCQQNNKDPPTFFGQGTKLEIKRAAAFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1301 - protein, 556 aa, Artificial Sequence
  source: /note="Description of Artificial Sequence: Synthetic Chimeric Antigen Receptor sequence"
LLVTSLLLCELPHPAFLLIPDTQVQLQQSGAEVKKPGSSVKVSCKASGFSLTSYAISWVRQAPGQGLEWMGGIIWSGGATNYAQKFQGRVTITADESTSTAYMELSSLRSEDTAVYYCAREHYYGSSAMDYWWGQGTMVTVSSGGGGSGGGGSGGGGSEIVLTQSPATLSLSPGERATLSCRASQSIVHSYGNTYAWYQQKPGQAPRLLIYRVSRATGIPARFSGSGSGTDFTLTISSLEPEDFAVYYCFQGTHVPYTFFGQGTKLEIKRAAAFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1302 - protein, 724 aa, Artificial Sequence
  source: /note="Description of Artificial Sequence: Synthetic Chimeric Antigen Receptor sequence"
LLVTSLLLCELPHPAFLLIPDTALQLQQSGAELVRPGASVTLSCKASGYTFTDYEMHWVKQTPVHGLEWIGAIDPETGGTAYNQKFEGKAILTADKSSSTAYMELRSLTSEDSPVYYCARRRYYGSSSFDYWGQGTTLTVSSGGGGSGGGGSGGGGSDVQMIQTPSSLSASLGDRVTISCRASQDIGNYLNWYQQKPDGTVKLLIYYTSRLHSGVPSRFSGSGSGTEYSLTISNLEQEDIATYFCQQGSALPPTFGGGTKLEINRAEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKKDPKAAAIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1303 - protein, 724 aa, Artificial Sequence
  source: /note="Description of Artificial Sequence: Synthetic Chimeric Antigen Receptor sequence"
LLVTSLLLCELPHPAFLLIPDTQVQLQQSGAEVKKPGSSVKVSCKASGYTFTDYEISWVRQAPGQGLEWMGGIDPETGGTNYAQKFQGRVTITADESTSTAYMELSSLRSEDTAVYYCARRRYYGSSSFDYWWGQGTMVTVSSGGGGSGGGGSGGGGSEIVLTQSPATLSLSPGERATLSCRASQDIGNYAWYQQKPGQAPRLLIYYTSRATGIPARFSGSGSGTDFTLTISSLEPEDFAVYYCQQGSALPPTFFGQGTKLEIKRAEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKKDPKAAAIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1304 - protein, 725 aa, Artificial Sequence
  source: /note="Description of Artificial Sequence: Synthetic Chimeric Antigen Receptor sequence"
LLVTSLLLCELPHPAFLLIPDTDVQLQESGPVLVKTGASVKMSCTASGYTFTDHFMDWVKQSHGKSLEWIGSLNPYSGGTSYNQKFKGKATLTVDKSSSTAYMELNSLTSVDSAVYYCARHNWGAYFDYWGQGTTLTVSSGGGGSGGGGSGGGGSDIVMTQAAPSVPVTPGESVSISCRSSKSLLHSNGNTYLYWFLQRPGQSPQRLIYYMSNLASGVPDRFSGRGSGTDFTLRISRVEAEDVGVYYCMQGLEDPYTFGGGTKLEIKEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKKDPKAAAIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1305 - protein, 726 aa, Artificial Sequence
  source: /note="Description of Artificial Sequence: Synthetic Chimeric Antigen Receptor sequence"
LLVTSLLLCELPHPAFLLIPDTQVQLQQSGAEVKKPGSSVKVSCKASGYTFTDHFISWVRQAPGQGLEWMGGLNPYSGGTNYAQKFQGRVTITADESTSTAYMELSSLRSEDTAVYYCARHNWGAYFDYWWGQGTMVTVSSGGGGSGGGGSGGGGSEIVLTQSPATLSLSPGERATLSCRASKSLLHSNGNTYAWYQQKPGQAPRLLIYYMSRATGIPARFSGSGSGTDFTLTISSLEPEDFAVYYCMQGLEDPYTFFGQGTKLEIKREPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKKDPKAAAIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1306 - protein, 728 aa, Artificial Sequence
  source: /note="Description of Artificial Sequence: Synthetic Chimeric Antigen Receptor sequence"
LLVTSLLLCELPHPAFLLIPDTALQLQQSGAELVRPGASVTLSCKASGYTFTDYEMHWVKQTPVHGLEWIGAIDPETGGTAYNQKFEGKAILTADKSSSTAYMELRSLTSEDSPVYYCARRRYYGSSSFDYWGQGTTLTVSSGGGGSGGGGSGGGGSDVQMIQTPSSLSASLGDRVTISCRASQDIGNYLNWYQQKPDGTVKLLIYYTSRLHSGVPSRFSGSGSGTEYSLTISNLEQEDIATYFCQQGSALPPTFGGGTKLEINRAEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKKDPKAAATTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1307 - protein, 728 aa, Artificial Sequence
  source: /note="Description of Artificial Sequence: Synthetic Chimeric Antigen Receptor sequence"
LLVTSLLLCELPHPAFLLIPDTQVQLQQSGAELVKPGASVKISCKASGYAFSSYWMNWVKQRPGKGLEWIGQIYPGDGDTTYNGKFKGKATLTADKSSSTVYMQLNSLTSEDSAVYFCVRYYYGSSGYFDYWGQGTTLTVSSGGGGSGGGGSGGGGSDVQMIQTPDSLAVSLGQRATISCRASESVDNYGISFMHWYQQKPGQSPKLLIYRASNLESGIPARFSGSGSRTDFTLTINPVETDDVATYYCQQNNKDPPTFGGGTKLEIKRAEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKKDPKAAAIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1308 - protein, 728 aa, Artificial Sequence
  source: /note="Description of Artificial Sequence: Synthetic Chimeric Antigen Receptor sequence"
LLVTSLLLCELPHPAFLLIPDTQVQLQQSGAEVKKPGSSVKVSCKASGFSLTSYAISWVRQAPGQGLEWMGGIIWSGGATNYAQKFQGRVTITADESTSTAYMELSSLRSEDTAVYYCAREHYYGSSAMDYWWGQGTMVTVSSGGGGSGGGGSGGGGSEIVLTQSPATLSLSPGERATLSCRASQSIVHSYGNTYAWYQQKPGQAPRLLIYRVSRATGIPARFSGSGSGTDFTLTISSLEPEDFAVYYCFQGTHVPYTFFGQGTKLEIKREPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKKDPKAAAIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1309 - protein, 728 aa, Artificial Sequence
  source: /note="Description of Artificial Sequence: Synthetic Chimeric Antigen Receptor sequence"
LLVTSLLLCELPHPAFLLIPDTQVQLQQSGAEVKKPGSSVKVSCKASGYAFSSYISWVRQAPGQGLEWMGGQIYPGDGDTNYAQKFQGRVTITADESTSTAYMELSSLRSEDTAVYYCVRYYYGSSGYFDYWWGQGTMVTVSSGGGGSGGGGSGGGGSEIVLTQSPATLSLSPGERATLSCRASESVDNYGISFAWYQQKPGQAPRLLIYRASRATGIPARFSGSGSGTDFTLTISSLEPEDFAVYYCQQNNKDPPTFFGQGTKLEIKRAEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKKDPKAAAIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1310 - protein, 728 aa, Artificial Sequence
  source: /note="Description of Artificial Sequence: Synthetic Chimeric Antigen Receptor sequence"
LLVTSLLLCELPHPAFLLIPDTQVQLQQSGAEVKKPGSSVKVSCKASGYTFTDYEISWVRQAPGQGLEWMGGIDPETGGTNYAQKFQGRVTITADESTSTAYMELSSLRSEDTAVYYCARRRYYGSSSFDYWWGQGTMVTVSSGGGGSGGGGSGGGGSEIVLTQSPATLSLSPGERATLSCRASQDIGNYAWYQQKPGQAPRLLIYYTSRATGIPARFSGSGSGTDFTLTISSLEPEDFAVYYCQQGSALPPTFFGQGTKLEIKRAEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKKDPKAAATTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1311 - protein, 729 aa, Artificial Sequence
  source: /note="Description of Artificial Sequence: Synthetic Chimeric Antigen Receptor sequence"
LLVTSLLLCELPHPAFLLIPDTDVQLQESGPVLVKTGASVKMSCTASGYTFTDHFMDWVKQSHGKSLEWIGSLNPYSGGTSYNQKFKGKATLTVDKSSSTAYMELNSLTSVDSAVYYCARHNWGAYFDYWGQGTTLTVSSGGGGSGGGGSGGGGSDIVMTQAAPSVPVTPGESVSISCRSSKSLLHSNGNTYLYWFLQRPGQSPQRLIYYMSNLASGVPDRFSGRGSGTDFTLRISRVEAEDVGVYYCMQGLEDPYTFGGGTKLEIKEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKKDPKAAATTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1312 - protein, 730 aa, Artificial Sequence
  source: /note="Description of Artificial Sequence: Synthetic Chimeric Antigen Receptor sequence"
LLVTSLLLCELPHPAFLLIPDTDVKLQESGPGLVAPSQSLSITCTVSGFSLTSYAVSWVRQPPGKGLEWLGIIWSGGATNYNSALKSRLSISKDNSKSQVFLKMNGLQTDDTARYYCAREHYYGSSAMDYWGQGASITVSSGGGGSGGGGSGGGGSGIVMTQSPLSLPVSLGDQASISCRSSQSIVHSYGNTYLFWYLQKPGQSPKLLIYRVSNRFSGVPDRFSGSGSGTNFTLKISRVEAEDMGVYYCFQGTHVPYTFGGGTKLEIKEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKKDPKAAATTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1313 - protein, 730 aa, Artificial Sequence
  source: /note="Description of Artificial Sequence: Synthetic Chimeric Antigen Receptor sequence"
LLVTSLLLCELPHPAFLLIPDTQVQLQQSGAEVKKPGSSVKVSCKASGYTFTDHFISWVRQAPGQGLEWMGGLNPYSGGTNYAQKFQGRVTITADESTSTAYMELSSLRSEDTAVYYCARHNWGAYFDYWWGQGTMVTVSSGGGGSGGGGSGGGGSEIVLTQSPATLSLSPGERATLSCRASKSLLHSNGNTYAWYQQKPGQAPRLLIYYMSRATGIPARFSGSGSGTDFTLTISSLEPEDFAVYYCMQGLEDPYTFFGQGTKLEIKREPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKKDPKAAATTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1314 - protein, 732 aa, Artificial Sequence
  source: /note="Description of Artificial Sequence: Synthetic Chimeric Antigen Receptor sequence"
LLVTSLLLCELPHPAFLLIPDTQVQLQQSGAELVKPGASVKISCKASGYAFSSYWMNWVKQRPGKGLEWIGQIYPGDGDTTYNGKFKGKATLTADKSSSTVYMQLNSLTSEDSAVYFCVRYYYGSSGYFDYWGQGTTLTVSSGGGGSGGGGSGGGGSDVQMIQTPDSLAVSLGQRATISCRASESVDNYGISFMHWYQQKPGQSPKLLIYRASNLESGIPARFSGSGSRTDFTLTINPVETDDVATYYCQQNNKDPPTFGGGTKLEIKRAEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKKDPKAAATTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1315 - protein, 732 aa, Artificial Sequence [sequence omitted]

SEQ ID NO: 1316 - protein, 732 aa, Artificial Sequence
  source: /note="Description of Artificial Sequence: Synthetic Chimeric Antigen Receptor sequence"
LLVTSLLLCELPHPAFLLIPDTQVQLQQSGAEVKKPGSSVKVSCKASGYAFSSYISWVRQAPGQGLEWMGGQIYPGDGDTNYAQKFQGRVTITADESTSTAYMELSSLRSEDTAVYYCVRYYYGSSGYFDYWWGQGTMVTVSSGGGGSGGGGSGGGGSEIVLTQSPATLSLSPGERATLSCRASESVDNYGISFAWYQQKPGQAPRLLIYRASRATGIPARFSGSGSGTDFTLTISSLEPEDFAVYYCQQNNKDPPTFFGQGTKLEIKRAEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKKDPKAAATTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1317 - protein, 788 aa, Artificial Sequence
  source: /note="Description of Artificial Sequence: Synthetic Chimeric Antigen Receptor sequence"
LLVTSLLLCELPHPAFLLIPDTALQLQQSGAELVRPGASVTLSCKASGYTFTDYEMHWVKQTPVHGLEWIGAIDPETGGTAYNQKFEGKAILTADKSSSTAYMELRSLTSEDSPVYYCARRRYYGSSSFDYWGQGTTLTVSSGGGGSGGGGSGGGGSDVQMIQTPSSLSASLGDRVTISCRASQDIGNYLNWYQQKPDGTVKLLIYYTSRLHSGVPSRFSGSGSGTEYSLTISNLEQEDIATYFCQQGSALPPTFGGGTKLEINRAEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKKDPKAAAFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1318 - protein, 788 aa, Artificial Sequence [sequence omitted]

SEQ ID NO: 1319 - protein, 789 aa, Artificial Sequence [sequence omitted]

SEQ ID NO: 1320 - protein, 790 aa, Artificial Sequence
  source: /note="Description of Artificial Sequence: Synthetic Chimeric Antigen Receptor sequence"
LLVTSLLLCELPHPAFLLIPDTDVKLQESGPGLVAPSQSLSITCTVSGFSLTSYAVSWVRQPPGKGLEWLGIIWSGGATNYNSALKSRLSISKDNSKSQVFLKMNGLQTDDTARYYCAREHYYGSSAMDYWGQGASITVSSGGGGSGGGGSGGGGSGIVMTQSPLSLPVSLGDQASISCRSSQSIVHSYGNTYLFWYLQKPGQSPKLLIYRVSNRFSGVPDRFSGSGSGTNFTLKISRVEAEDMGVYYCFQGTHVPYTFGGGTKLEIKEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKKDPKAAAFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1321 - protein, 790 aa, Artificial Sequence
  source: /note="Description of Artificial Sequence: Synthetic Chimeric Antigen Receptor sequence"
LLVTSLLLCELPHPAFLLIPDTQVQLQQSGAEVKKPGSSVKVSCKASGYTFTDHFISWVRQAPGQGLEWMGGLNPYSGGTNYAQKFQGRVTITADESTSTAYMELSSLRSEDTAVYYCARHNWGAYFDYWWGQGTMVTVSSGGGGSGGGGSGGGGSEIVLTQSPATLSLSPGERATLSCRASKSLLHSNGNTYAWYQQKPGQAPRLLIYYMSRATGIPARFSGSGSGTDFTLTISSLEPEDFAVYYCMQGLEDPYTFFGQGTKLEIKREPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKKDPKAAAFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1322 - protein, 792 aa, Artificial Sequence
  source: /note="Description of Artificial Sequence: Synthetic Chimeric Antigen Receptor sequence"
LLVTSLLLCELPHPAFLLIPDTQVQLQQSGAELVKPGASVKISCKASGYAFSSYWMNWVKQRPGKGLEWIGQIYPGDGDTTYNGKFKGKATLTADKSSSTVYMQLNSLTSEDSAVYFCVRYYYGSSGYFDYWGQGTTLTVSSGGGGSGGGGSGGGGSDVQMIQTPDSLAVSLGQRATISCRASESVDNYGISFMHWYQQKPGQSPKLLIYRASNLESGIPARFSGSGSRTDFTLTINPVETDDVATYYCQQNNKDPPTFGGGTKLEIKRAEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKKDPKAAAFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1323 - protein, 792 aa, Artificial Sequence
  source: /note="Description of Artificial Sequence: Synthetic Chimeric Antigen Receptor sequence"
LLVTSLLLCELPHPAFLLIPDTQVQLQQSGAEVKKPGSSVKVSCKASGFSLTSYAISWVRQAPGQGLEWMGGIIWSGGATNYAQKFQGRVTITADESTSTAYMELSSLRSEDTAVYYCAREHYYGSSAMDYWWGQGTMVTVSSGGGGSGGGGSGGGGSEIVLTQSPATLSLSPGERATLSCRASQSIVHSYGNTYAWYQQKPGQAPRLLIYRVSRATGIPARFSGSGSGTDFTLTISSLEPEDFAVYYCFQGTHVPYTFFGQGTKLEIKREPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKKDPKAAAFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1324 - protein, 792 aa, Artificial Sequence
  source: /note="Description of Artificial Sequence: Synthetic Chimeric Antigen Receptor sequence"
LLVTSLLLCELPHPAFLLIPDTQVQLQQSGAEVKKPGSSVKVSCKASGYAFSSYISWVRQAPGQGLEWMGGQIYPGDGDTNYAQKFQGRVTITADESTSTAYMELSSLRSEDTAVYYCVRYYYGSSGYFDYWWGQGTMVTVSSGGGGSGGGGSGGGGSEIVLTQSPATLSLSPGERATLSCRASESVDNYGISFAWYQQKPGQAPRLLIYRASRATGIPARFSGSGSGTDFTLTISSLEPEDFAVYYCQQNNKDPPTFFGQGTKLEIKRAEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKKDPKAAAFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1325 - protein, 614 aa, Artificial Sequence
  source: /note="Description of Artificial Sequence: Synthetic Chimeric Antigen Receptor sequence"
METDTLLLWVLLLWVPGSTGSVLHLVPINATSKDDSDVTEVMWQPALRRGRGLQAQGYGVRIQDAGVYLLYSQVLFQDVTFTMGQVVSREGQGRQETLFRCIRSMPSHPDRAYNSCYSAGVFHLHQGDILSVIIPRARAKLNLSPHGTFLGFVKLSGGGSDPAEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKKDPKFWVLVVVGGVLACYSLLVTVAFIIFWVRSKRSRLLHSDYMNMTPRRPGPTRKHYQPYAPPRDFAAYRSRDQRLPPDAHKPPGGGSFRTPIQEEQADAHSTLAKIRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1326 - protein, 398 aa, Artificial Sequence
  source: /note="Description of Artificial Sequence: Synthetic Chimeric Antigen Receptor sequence"
METDTLLLWVLLLWVPGSTGSVLHLVPINATSKDDSDVTEVMWQPALRRGRGLQAQGYGVRIQDAGVYLLYSQVLFQDVTFTMGQVVSREGQGRQETLFRCIRSMPSHPDRAYNSCYSAGVFHLHQGDILSVIIPRARAKLNLSPHGTFLGFVKLSGGGSDPAEPKSPDKTHTCPPCPKDPKFWVLVVVGGVLACYSLLVTVAFIIFWVRSKRSRLLHSDYMNMTPRRPGPTRKHYQPYAPPRDFAAYRSRDQRLPPDAHKPPGGGSFRTPIQEEQADAHSTLAKIRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1327 - protein, 482 aa, Artificial Sequence; identical to SEQ ID NO: 1273
  source: /note="Description of Artificial Sequence: Synthetic polypeptide"

SEQ ID NO: 1328 - protein, 480 aa, Artificial Sequence
  source: /note="Description of Artificial Sequence: Synthetic polypeptide"
MALPVTALLLPLALLLHAARPEVQLVESGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSSASGGGGSGGRASGGGGSDIQLTQSPSSLSASVGDRVTITCRASQSISSYLNWYQQKPGKAPKLLIYAASSLQSGVPSRFSGSGSGTDFTLTISSLQPEDFATYYCQQSYSTPYTFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQAL

SEQ ID NO: 1329 - protein, 136 aa, Artificial Sequence
  source: /note="Description of Artificial Sequence: Synthetic Chimeric Antigen Receptor sequence"
CPYSNPSLCSGGGGSELPTQGTFSNVSTNVSPAKPTTTACPYSNPSLCSGGGGSPAPRPPTPAPTIASQPLSLRPEACRPAAGGAVHTRGLDFACDIYIWAPLAGTCGVLLLSLVITLYCNHRNRRRVCKCPRPVV

SEQ ID NO: 1330 - protein, 212 aa, Artificial Sequence
  source: /note="Description of Artificial Sequence: Synthetic Chimeric Antigen Receptor sequence"
MALPVTALLLPLALLLHAARPEVQLVETGGGLVQPGGSLRLSCAASGFTFSSYAMSWVRQAPGKGLEWVSAISGSGGSTYYADSVKGRFTISRDNSKNTLYLQMNTLKAEDTAVYYCARATYKRELRYYYGMDVWGQGTTVTVSSGGGGSGGGGSGGGGSEIVLTQSPSTLSLSPGESATLSCRASQSVSTTFLAWYQQKPGQAPRLLIYGS

SEQ ID NO: 1331 - protein, 391 aa, Artificial Sequence
  source: /note="Description of Artificial Sequence: Synthetic Chimeric Antigen Receptor sequence"
MALPVTALLLPLALLLHAARPGSGSGAQAAQVQLVQSGAEVKKPGASVKVSCKASGYSFPDYYINWVRQAPGQGLEWMGWIYFASGNSEYNQKFTGRVTMTRDTSSSTAYMELSSLRSEDTAVYFCASLYDYDWYFDVWGQGTMVTVSSGGGGSGGGGSGGGGSDIVMTQTPLSLSVTPGEPASISCKSSQSLVHSNGNTYLHWYLQKPGQSPQLLIYKVSNRFSGVPDRFSGSGSGADFTLKISRVEAEDVGVYYCAETSHVPWTFGQGTKLEIKRSDPASGAGSGSGSAIELLPVPGAKKSAKLYIPYIILTIIILTIVGFIWLLKVNGCRKYKLNKTESTPVVEEDEMQPYASYTEKNNPLYDTTNKVKASEALQSEVDTDLHTLSHG

SEQ ID NO: 1332 - protein, 394 aa, Artificial Sequence
  source: /note="Description of Artificial Sequence: Synthetic Chimeric Antigen Receptor sequence"
METDTLLLWVLLLWVPGSTGSVLHLVPINATSKDDSDVTEVMWQPALRRGRGLQAQGYGVRIQDAGVYLLYSQVLFQDVTFTMGQVVSREGQGRQETLFRCIRSMPSHPDRAYNSCYSAGVFHLHQGDILSVIIPRARAKLNLSPHGTFLGFVLSGGGSDPAEPKSPDKTHTCPPCPDPFWVLWVGGVLACYSLLVTVAFIIFWVRSKRSRLLHSDYMNMTPRRPGPTRKHYQPYAPPRDFAAYRSRDQRLPPDAHKPPGGGSFRTPIQEEQADAHSTLAKIRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1333 - protein, 416 aa, Artificial Sequence
  source: /note="Description of Artificial Sequence: Synthetic Chimeric Antigen Receptor sequence"
MGTSLLCWMALCLLGADHADGKPIPNPLLGLDSTSGGGGSVLHLVPINATSKDDSDVTEVMWQPALRRGRGLQAQGYGVRIQDAGVYLLYSQVLFQDVTFTMGQVVSREGQGRQETLFRCIRSMPSHPDRAYNSCYSAGVFHLHQGDILSVIIPRARAKLNLSPHGTFLGFVKLSGGGSDPAEPKSPDKTHTCPPCPKDPKFWVLVVVGGVLACYSLLVTVAFIIFVRSKRSRLLHSDYMNMTPRRPGPTRKHYQPYAPPRDFAAYRSRDQRLPPDAHKPPGGGSFRTPIQEEQADAHSTLAKIRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1334 - protein, 417 aa, Artificial Sequence
  source: /note="Description of Artificial Sequence: Synthetic Chimeric Antigen Receptor sequence"
MGTSLLCWMALCLLGADHADGKPIPNPLLGLDSTSGGGGSVLHLVPINATSKDDSDVTEVMWQPALRRGRGLQAQGYGVRIQDAGVYLLYSQVLFQDVTFTMGQVVSREGQGRQETLFRCIRSMPSHPDRAYNSCYSAGVFHLHQGDILSVIIPRARAKLNLSPHGTFLGFVKLSGGGSDPAEPKSPDKTHTCPPCPKDPKFWVLVVVGGVLACYSLLVTVAFIIFWVRSKRSRLLHSDYMNMTPRRPGPTRKHYQPYAPPRDFAAYRSRDQRLPPDAHKPPGGGSFRTPIQEEQADAHSTLAKIRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1335 - protein, 422 aa, Artificial Sequence
  source: /note="Description of Artificial Sequence: Synthetic Chimeric Antigen Receptor sequence"
METDTLLLWVLLLWVPGSTGSVLHLVPINATSKDDSDVTEVMWQPALRRGRGLQAQGYGVRIQDAGVYLLYSQVLFQDVTFTMGQVVSREGQGRQETLFRCIRSMPSHPDRAYNSCYSAGVFHLHQGDILSVIIPRARAKLNLSPHGTFLGFVKLSGGGSDPTTTPAPRPPTPAPTIASQPLSLRPEACRPAAGGAVHTRGLDFACDIFWVLVVVGGVLACYSLLVTVAFIIFWVRSKRSRLLHSDYMNMTPRRPGPTRKHYQPYAPPRDFAAYRSRDQRLPPDAHKPPGGGSFRTPIQEEQADAHSTLAKIRVKFSRSADAPAYQQGQNQLYNELNLGRREEYDVLDKRRGRDPEMGGKPRRKNPQEGLYNELQKDKAEAYSEIGMKGERRRGKGHDGLYQGLSTATKDYDALHMQALPPR

SEQ ID NO: 1336 - protein, 438 aa, Artificial Sequence
  source: /note="Description of Artificial Sequence: Synthetic Chimeric Antigen Receptor sequence"
MGTSLLCMALCLLGADHADGKPIPNPLLGLDSTSGGGGSVLHLVPINATSKDDSDVTEVMWQPALRRGRGLQAQGYGVRIQDAGVYLLYSQVLFQDVTFTMGQWSREGQGRQETLFRCIRSMPSHPDRAYNSCYSAGVFHLHQGDILSIIPRARAKLNLSPHGTFLGFVKLSGGGSDPTTTPAPRPPTPAPTIASQPLSLRPEACRPAAGGAVHTRGLDFACDIFWVLWVGGVLACYSLLVTVAFIIFWVRSKRSRLLHSDYMNMTPRRPGPTRKHYQPYAPPRDFAAYRSRDQRLPPDAHKPPGGGSFRTPIQEEQADAHSTLAKIRVKFSRSADAPAYQQGQNQLYNELNLGRREEYDVLDKRRGRDPEMGGKPRRKNPQEGLYNELQKDKMAEAYSEIGMKGERRRGKGHDGLYQGLSATKDTYDALHMQALPPR

SEQ ID NO: 1337 - protein, 443 aa, Artificial Sequence
  source: /note="Description of Artificial Sequence: Synthetic Chimeric Antigen Receptor sequence"
MGTSLLCWMALCLLGADHADGKPIPNPLLGLDSTSGGGGSVLHLVPINATSKDDSDVTEVMWQPALRRGRGLQAQGYGVRIQDAGVYLLYSQVLFQDVTFTMGQVVSREGQGRQETLFRCIRSMPSHPDRAYNSCYSAGVFHLHQGDILSVIIPRARAKLNLSPHGTFLGFVKLSGGGSDPTTTPAPRPPTPAPTIASQPLSLRPEACRPAAGGAVHTRGLDFACDIFWVLVVVGGVLACYSLLVTVAFIIFWVRSKRSRLLHSDYMNMTPRRPGPTRKHYQPYAPPRDFAAYRSRDQRLPPDAHKPPGGGSFRTPIQEEQADAHSTLAKIRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1338 - protein, 461 aa, Artificial Sequence
  source: /note="Description of Artificial Sequence: Synthetic Chimeric Antigen Receptor sequence"
MALPVTALLLPLALLLHAARPQVQLVQSGAEVKKPGASVKVSCKASGYSFPDYYINWVRQAPGQGLEWMGWIYFASGNSEYNQKFTGRVTMTRDTSINTAYMELSSLTSEDTAVYFCASLYDYDWYFDVWGQGTMVTVSSGGGGSGGGGSGGGGSDIVMTQTPLSLSVTPGQPASISCKSSQSLVHSNGNTYLHWYLQKPGQSPQLLIYKVSNRFSGVPDRFSGSGSGTDFTLKISRVEAEDVGIYYCSQSSIYPWTFGQGTKLEIKGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1339 - protein, 461 aa, Artificial Sequence
  source: /note="Description of Artificial Sequence: Synthetic Chimeric Antigen Receptor sequence"
MALPVTALLLPLALLLHAARPQVQLVQSGAEVKKPGASVKVSCKASGYSFPDYYINWVRQAPGQGLEWMGWIYFASGNSEYNQKFTGRVTMTRDTSSSTAYMELSSLRSEDTAVYFCASLYDYDWYFDVWGQGTMVTVSSGGGGSGGGGSGGGGSDIVMTQTPLSLSVTPGEPASISCKSSQSLVHSNGNTYLHWYLQKPGQSPQLLIYKVSNRFSGVPDRFSGSGSGADFTLKISRVEAEDVGVYYCAETSHVPWTFGQGTKLEIKGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1340 - protein, 464 aa, Artificial Sequence
  source: /note="Description of Artificial Sequence: Synthetic Chimeric Antigen Receptor sequence"
EVQLLESGGGLVQPGGSLRLSCAASGFTFSSYAMNWVRQAPGKGLEWVSAILSSGGSTYYADSVKGRFTISRDNSKNTLYLQMNSLRAEDTAVYYCARYWPMDIWGQGTLVTVSSGGGGSGGGGSGGGGSEIVLTQSPGTLSLSPGERATLSCRGGQSVSSSYLAWYQQKPGQAPRLLMYDASIRATGIPDRFSGSGSGTDFTLTISRLEPEDFAVYYCQQYQSWPLTFGQGTKVEIKAPTTTPAPRPPTPAPTIASQPLSLRPEACRPAAGGAVHTRGLDFACDIYIWAPLAGTCGVLLLSLVITLYCRRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRE

SEQ ID NO: 1341 - protein, 464 aa, Artificial Sequence
  source: /note="Description of Artificial Sequence: Synthetic Chimeric Antigen Receptor sequence"
MALPVTALLLPLALLLHAARPQVQLVQSGAEVKKPGASVKVSCKASGYSFPDYYINWVRQAPGQGLEWMGWIYFASGNSEYNQKFTGRVTMTRDTSINTAYMELSSLTSEDTAVYFCASLYDYDWYFDVWGQGTMVTVSSGGGGSGGGGSGGGGSDIVMTQTPLSLSVTPGQPASISCKSSQSLVHSNGNTYLHWYLQKPGQSPQLLIYKVSNRFSGVPDRFSGSGSGTDFTLKISRVEAEDVGIYYCSQSSIYPWTFGQGTKLEIKGLAVSTISSFFPPGYQIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1342 - protein, 464 aa, Artificial Sequence
  source: /note="Description of Artificial Sequence: Synthetic Chimeric Antigen Receptor sequence"
MALPVTALLLPLALLLHAARPQVQLVQSGAEVKKPGASVKVSCKASGYSFPDYYINWVRQAPGQGLEWMGWIYFASGNSEYNQKFTGRVTMTRDTSSSTAYMELSSLRSEDTAVYFCASLYDYDWYFDVWGQGTMVTVSSGGGGSGGGGSGGGGSDIVMTQTPLSLSVTPGEPASISCKSSQSLVHSNGNTYLHWYLQKPGQSPQLLIYKVSNRFSGVPDRFSGSGSGADFTLKISRVEAEDVGVYYCAETSHVPWTFGQGTKLEIKGLAVSTISSFFPPGYQIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1343 - protein, 466 aa, Artificial Sequence
  source: /note="Description of Artificial Sequence: Synthetic Chimeric Antigen Receptor sequence"
EVQLLESGGGLVQPGGSLRLSCAASGFTFSSYAMNWVRQAPGKGLEWVSAILSSGGSTYYADSVKGRFTISRDNSKNTLYLQMNSLRAEDTAVYYCARYWPMDIWGQGTLVTVSSGGSCPYSNPSLCSGGSEIVLTQSPGTLSLSPGERATLSCRGGQSVSSSYLAWYQQKPGQAPRLLMYDASIRATGIPDRFSGSGSGTDFTLTISRLEPEDFAVYYCQQYQSWPLTFGQGTKVEIKSDPTTTPAPRPPTPAPTIASQPLSLRPEACRPAAGGAVHTRGLDFACDIYIWAPLAGTCGVLLLSLVITLYCRRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRE

SEQ ID NO: 1344 - protein, 466 aa, Artificial Sequence
  source: /note="Description of Artificial Sequence: Synthetic Chimeric Antigen Receptor sequence"
QIQLVQSGPELKKPGETVKISCKASGYTFRHYSMNWVKQAPGKGLKWMGRINTESGVPIYADDFKGRFAFSVETSASTAYLVINNLKDEDTASYFCSNDYLYSLDFWGQGTALTVSSGGGGSGGGGSGGGGSDIVLTQSPPSLAMSLGKRATISCRASESVTILGSHLIYWYQQKPGQPPTLLIQLASNVQTGVPARFSGSGSRTDFTLTIDPVEEDDVAVYYCLQSRTIPRTFGGGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1345 - protein, 466 aa, Artificial Sequence
  source: /note="Description of Artificial Sequence: Synthetic Chimeric Antigen Receptor sequence"
QIQLVQSGPELKKPGETVKISCKASGYTFTHYSMNWVKQAPGKGLKWMGRINTETGEPLYADDFKGRFAFSLETSASTAYLVINNLKNEDTATFFCSNDYLYSCDYWGQGTTLTVSSGGGGSGGGGSGGGGSDIVLTQSPPSLAMSLGKRATISCRASESVTILGSHLIYWYQQKPGQPPTLLIQLASNVQTGVPARFSGSGSRTDFTLTIDPVEEDDVAVYYCLQSRTIPRTFGGGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1346 - protein, 467 aa, Artificial Sequence
  source: /note="Description of Artificial Sequence: Synthetic Chimeric Antigen Receptor sequence"
QIQLVQSGPDLKKPGETVKLSCKASGYTFTNFGMNWVKQAPGKGFKWMAWINTYTGESYFADDFKGRFAFSVETSATTAYLQINNLKTEDTATYFCARGEIYYGYDGGFAYWGQGTLVTVSAGGGGSGGGGSGGGGSDVVMTQSHRFMSTSVGDRVSITCRASQDVNTAVSWYQQKPGQSPKLLIFSASYRYTGVPDRFTGSGSGADFTLTISSVQAEDLAVYYCQQHYSTPWTFGGGTKLDIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1347 - protein, 469 aa, Artificial Sequence
  source: /note="Description of Artificial Sequence: Synthetic Chimeric Antigen Receptor sequence"
QVQLVQSGAEVKKPGASVKVSCKASGYSFPDYYINWVRQAPGQGLEWMGWIYFASGNSEYNQKFTGRVTMTRDTSSSTAYMELSSLRSEDTAVYFCASLYDYDWYFDVWGQGTMVTVSSGGGGSGGGGSGGGGSDIVMTQTPLSLSVTPGEPASISCKSSQSLVHSNGNTYLHWYLQKPGQSPQLLIYKVSNRFSGVPDRFSGSGSGADFTLKISRVEAEDVGVYYCAETSHVPWTFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1348 - protein, 472 aa, Artificial Sequence
  source: /note="Description of Artificial Sequence: Synthetic Chimeric Antigen Receptor sequence"
EVQLLESGGGLVQPGGSLRLSCAASGFTFSSYAMNWVRQAPGKGLEWVSAILSSGGSTYYADSVKGRFTISRDNSKNTLYLQMNSLRAEDTAVYYCARYWPMDIWGQGTLVTVSSGGGGGSCPYSNPSLCSGGGGGSEIVLTQSPGTLSLSPGERATLSCRGGQSVSSSYLAWYQQKPGQAPRLLMYDASIRATGIPDRFSGSGSGTDFTLTISRLEPEDFAVYYCQQYQSWPLTFGQGTKVEIKSDPTTTPAPRPPTPAPTIASQPLSLRPEACRPAAGGAVHTRGLDFACDIYIWAPLAGTCGVLLLSLVITLYCRRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRE

SEQ ID NO: 1349 - protein, 472 aa, Artificial Sequence
  source: /note="Description of Artificial Sequence: Synthetic Chimeric Antigen Receptor sequence"
QIQLVQSGPELKKPGETVKISCKASGYTFTDYSINWVKRAPGKGLKWMGWINTETREPAYAYDFRGRFAFSLETSASTAYLQINNLKYEDTATYFCALDYSYAMDYWGQGTSVTVSSGGGGSGGGGSGGGGSQIQLVQSGPELKKPGETVKISCKASGYTFTDYSINWVKRAPGKGLKWMGWINTETREPAYAYDFRGRFAFSLETSASTAYLQINNLKYEDTATYFCALDYSYAMDYWGQGTSVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1350 - protein, 483 aa, Artificial Sequence
  source: /note="Description of Artificial Sequence: Synthetic Chimeric Antigen Receptor sequence"
MALPVTALLLPLALLLHAARPEVQLVESGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSSASGGGGSGGRASGGGGSDIQLTQSPSSLSASVGDRVTITCRASQSISSYLNWYQQKPGKAPKLLIYAASSLQSGVPSRFSGSGSGTDFTLTISSLQPEDFATYYCQQSYSTPYTFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1351 - protein, 483 aa, Artificial Sequence
  source: /note="Description of Artificial Sequence: Synthetic Chimeric Antigen Receptor sequence"
MALPVTALLLPLALLLHAARPEVQLVETGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSSASGGGGSGGRASGGGGSEIVMTQSPATLSVSPGERATLSCRASQSVSSKLAWYQQKPGQAPRLLMYGASIRATGIPDRFSGSGSGTEFTLTISSLEPEDFAVYYCQQYGSSSWTFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1352 - protein, 485 aa, Artificial Sequence
  source: /note="Description of Artificial Sequence: Synthetic Chimeric Antigen Receptor sequence"
MALPVTALLLPLALLLHAARPDIVLTQSPASLAVSLGERATINCRASESVSVIGAHLIHWYQQKPGQPPKLLIYLASNLETGVPARFSGSGSGTDFTLTISSLQAEDAAIYYCLQSRIFPRTFGQGTKLEIKGSTSGSGKPGSGEGSTKGQVQLVQSGSELKKPGASVKVSCKASGYTFTDYSINWVRQAPGQGLEWMGWINTETREPAYAYDFRGRFVFSLDTSVSTAYLQISSLKAEDTAVYYCARDYSYAMDYWGQGTLVTVSSAAAQIKESLRAELRVTERRAEVPTAHPSPSPRPAGQFQTLVVGVVGGLLGSLVLLVWVLAVICSKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1353 - protein, 485 aa, Artificial Sequence
  source: /note="Description of Artificial Sequence: Synthetic Chimeric Antigen Receptor sequence"
MALPVTALLLPLALLLHAARPEVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCAKVVRDGMDVWGQGTTVTVSSGGGGSGGGGSGGGGSEIVLTQSPATLSLSPGERATLSCRASQSVSSSYLAWYQQKPGQAPRLLIYGASSRATGIPDRFSGNGSGTDFTLTISRLEPEDFAVYYCQQYGSPPRFTFGPGTKVDIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1354 - protein, 485 aa, Artificial Sequence
  source: /note="Description of Artificial Sequence: Synthetic Chimeric Antigen Receptor sequence"
MALPVTALLLPLALLLHAARPEVQLVETGGGLVQPGGSLRLSCAASGITFSRYPMSWVRQAPGKGLEWVSGISDSGVSTYYADSAKGRFTISRDNSKNTLFLQMSSLRDEDTAVYYCVTRAGSEASDIWGQGTMVTVSSGGGGSGGGGSGGGGSEIVLTQSPATLSLSPGERATLSCRASQSVSNSLAWYQQKPGQAPRLLIYDASSRATGIPDRFSGSGSGTDFTLTISRLEPEDFAIYYCQQFGTSSGLTFGGGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1355 - protein, 485 aa, Artificial Sequence
  source: /note="Description of Artificial Sequence: Synthetic Chimeric Antigen Receptor sequence"
MALPVTALLLPLALLLHAARPEVQLVETGGGVVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSSASGGGGSGGRASGGGGSEIVLTQSPGTLSLSPGERATLSCRASQSVGSTNLAWYQQKPGQAPRLLIYDASNRATGIPDRFSGGGSGTDFTLTISRLEPEDFAVYYCQQYGSSPPWTFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1356 - protein, 485 aa, Artificial Sequence
  source: /note="Description of Artificial Sequence: Synthetic Chimeric Antigen Receptor sequence"
MALPVTALLLPLALLLHAARPQVQLVQSGAEVKKPGASVKVSCKPSGYTVTSHYIHWVRRAPGQGLEWMGMINPSGGVTAYSQTLQGRVTMTSDTSSSTVYMELSSLRSEDTAMYYCAREGSGSGWYFDFWGRGTLVTVSSGGGGSGGGGSGGGGSSYVLTQPPSVSVSPGQTASITCSGDGLSKKYVSWYQQKAGQSPVVLISRDKERPSGIPDRFSGSNSADTATLTISGTQAMDEADYYCQAWDDTTVVFGGGTKLTVLTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1357 - protein, 485 aa, Artificial Sequence
  source: /note="Description of Artificial Sequence: Synthetic Chimeric Antigen Receptor sequence"
QVQLVQSGAEVKKPGASVKVSCKASGYSFPDYYINWVRQAPGQGLEWMGWIYFASGNSEYNQKFTGRVTMTRDTSSSTAYMELSSLRSEDTAVYFCASLYDYDWYFDVWGQGTMVTVSSGGGGSGGGGSGGGGSDIVMTQTPLSLSVTPGEPASISCKSSQSLVHSNGNTYLHWYLQKPGQSPQLLIYKVSNRFSGVPDRFSGSGSGADFTLKISRVEAEDVGVYYCAETSHVPWTFGQGTKLEIKGSGGGGSCPYSNPSLCTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1358 - protein, 487 aa, Artificial Sequence
  source: /note="Description of Artificial Sequence: Synthetic Chimeric Antigen Receptor sequence"
MALPVTALLLPLALLLHAARPDIVLTQSPASLAVSLGERATINCRASESVSVIGAHLIHWYQQKPGQPPKLLIYLASNLETGVPARFSGSGSGTDFTLTISSLQAEDAAIYYCLQSRIFPRTFGQGTKLEIKGSTSGSGKPGSGEGSTKGQVQLVQSGSELKKPGASVKVSCKASGYTFTDYSINWVRQAPGQGLEWMGWINTETREPAYAYDFRGRFVFSLDTSVSTAYLQISSLKAEDTAVYYCARDYSYAMDYWGQGTLVTVSSAAADTGLYICKVELMYPPPYYLGIGNGTQIYVIDPEPCPDSDFLLWILAAVSSGLFFYSFLLTAVSKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1359 - protein, 488 aa, Artificial Sequence
  source: /note="Description of Artificial Sequence: Synthetic Chimeric Antigen Receptor sequence"
MALPVTALLLPLALLLHAARPQVNLRESGPALVKPTQTLTLTCTFSGFSLRTSGMCVSWIRQPPGKALEWLARIDWDEDKFYSTSLKTRLTISKDTSDNQVVLRMTNMDPADTATYYCARSGAGGTSATAFDIWGPGTMVTVSSGGGGSGGGGSGGGGSDIQMTQSPSSLSASVGDRVTITCRASQDIYNNLWFQLKPGSAPRSLMYAANKSQSGVPSRFSGSASGTDFTLTISSLQPEDFATYYCQHYYRFPYSFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1360 - protein, 488 aa, Artificial Sequence
  source: /note="Description of Artificial Sequence: Synthetic Chimeric Antigen Receptor sequence"
MALPVTALLLPLALLLHAARPQVQLQESGPGLVKPSQTLSLTCTVSGGSISSGGYYWSWIRQHPGKGLEWIGYIYYSGSTYYNPSLKSRVTISVDTSKNQFSLKLSSVTAADTAVYYCARAGIAARLRGAFDIWGQGTMVTVSSGGGGSGGGGSGGGGSDIVMTQSPSSVSASVGDRVIITCRASQGIRNWLWYQQKPGKAPNLLIYAASNLQSGVPSRFSGSGSGADFTLTISSLQPEDVATYYCQKYNSAPFTFGPGTKVDIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1361 - protein, 489 aa, Artificial Sequence
  source: /note="Description of Artificial Sequence: Synthetic Chimeric Antigen Receptor sequence"
MALPVTALLLPLALLLHAARPEVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCAKMGWSSGYLGAFDIWGQGTTVTVSSGGGGSGGGGSGGGGSEIVLTQSPGTLSLSPGERATLSCRASQSVASSFLWYQQKPGQAPRLLIYGASGRATGIPDRFSGSGSGTDFTLTISRLEPEDFAVYYCQHYGGSPRLIFGGGTKVDIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1362 - protein, 489 aa, Artificial Sequence
  source: /note="Description of Artificial Sequence: Synthetic Chimeric Antigen Receptor sequence"
MALPVTALLLPLALLLHAARPEVQLVESGGGLVQPGRSLRLSCTASGFTFDDYAMHWVRQRPGKGLEWVASINWKGNSLAYGDSVKGRFAISRDNAKNTVFLQMNSLRTEDTAVYYCASHQGVAYYNYAMDVWGRGTLVTVSSGGGGSGGGGSGGGGSEIVLTQSPGTLSLSPGERATLSCRATQSIGSSFLWYQQRPGQAPRLLIYGASQRATGIPDRFSGRGSGTDFTLTISRVEPEDSAVYYCQHYESSPSWIFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1363 - protein, 489 aa, Artificial Sequence
  source: /note="Description of Artificial Sequence: Synthetic Chimeric Antigen Receptor sequence"
MALPVTALLLPLALLLHAARPQVQLQESGGGLVQPGGSLRLSCAASGFTFSSDAMTWVRQAPGKGLEWVSVISGSGGTTYYADSVKGRFTISRDNSKNTLYLQMNSLRAEDTAVYYCAKLDSSGYYYARGPRYWGQGTLVTVSSASGGGGSGGRASGGGGSDIQLTQSPSSLSASVGDRVTITCRASQSISSYLNWYQQKPGKAPKLLIYGASTLASGVPARFSGSGSGTHFTLTINSLQSEDSATYYCQQSYKRAFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1364 - protein, 489 aa, Artificial Sequence
  source: /note="Description of Artificial Sequence: Synthetic Chimeric Antigen Receptor sequence"
MALPVTALLLPLALLLHAARPQVQLVESGGGLVQPGRSLRLSCAASGFTFSNYAMSWVRQAPGKGLGWVSGISRSGENTYYADSVKGRFTISRDNSKNTLYLQMNSLRDEDTAVYYCARSPAHYYGGMDVWGQGTTVTVSSASGGGGSGGRASGGGGSDIVLTQSPGTLSLSPGERATLSCRASQSISSSFLWYQQKPGQAPRLLIYGASRRATGIPDRFSGSGSGTDFTLTISRLEPEDSAVYYCQQYHSSPSWIFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1365 - protein, 490 aa, Artificial Sequence
  source: /note="Description of Artificial Sequence: Synthetic Chimeric Antigen Receptor sequence"
EVQLLESGGGLVQPGGSLRLSCAASGFTFSSYAMNWVRQAPGKGLEWVSAILSSGGSTYYADSVKGRFTISRDNSKNTLYLQMNSLRAEDTAVYYCARYWPMDIWGQGTLVTVSSGGSCPYSNPSLCSGGSEIVLTQSPGTLSLSPGERATLSCRGGQSVSSSYLAWYQQKPGQAPRLLMYDASIRATGIPDRFSGSGSGTDFTLTISRLEPEDFAVYYCQQYQSWPLTFGQGTKVEIKSDPGSGGGGSCPYSNPSLCSGGGGSAPTTTPAPRPPTPAPTIASQPLSLRPEACRPAAGGAVHTRGLDFACDIYIWAPLAGTCGVLLLSLVITLYCRRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRE

SEQ ID NO: 1366 - protein, 490 aa, Artificial Sequence
  source: /note="Description of Artificial Sequence: Synthetic Chimeric Antigen Receptor sequence"
MALPVTALLLPLALLLHAARPEVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCAKTIAAVYAFDIWGQGTTVTVSSGGGGSGGGGSGGGGSEIVLTQSPLSLPVTPEEPASISCRSSQSLLHSNGYNYLDWYLQKPGQSPQLLIYLGSNRASGVPDRFSGSGSGTDFTLKISRVEAEDVGVYYCMQALQTPYIFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1367 - protein, 490 aa, Artificial Sequence
  source: /note="Description of Artificial Sequence: Synthetic Chimeric Antigen Receptor sequence"
MALPVTALLLPLALLLHAARPEVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCAKVEGSGSLDYWGQGTLVTVSSGGGGSGGGGSGGGGSEIVMTQSPGTLSLSPGERATLSCRASQSVSSAYLAWYQQKPGQPPRLLISGASTRATGIPDRFGGSGSGTDFTLTISRLEPEDFAVYYCQHYGSSFNGSSLFIFGQGTRLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1368 - protein, 490 aa, Artificial Sequence
  source: /note="Description of Artificial Sequence: Synthetic Chimeric Antigen Receptor sequence"
MALPVTALLLPLALLLHAARPQVQLVQSGAEVKKPGASVKVSCKASGYSFPDYYINWVRQAPGQGLEWMGWIYFASGNSEYNQKFTGRVTMTRDTSINTAYMELSSLTSEDTAVYFCASLYDYDWYFDVWGQGTMVTVSSGGGGSGGGGSGGGGSDIVMTQTPLSLSVTPGQPASISCKSSQSLVHSNGNTYLHWYLQKPGQSPQLLIYKVSNRFSGVPDRFSGSGSGTDFTLKISRVEAEDVGIYYCSQSSIYPWTFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1369 - protein, 490 aa, Artificial Sequence
  source: /note="Description of Artificial Sequence: Synthetic Chimeric Antigen Receptor sequence"
MALPVTALLLPLALLLHAARPQVQLVQSGAEVKKPGASVKVSCKASGYSFPDYYINWVRQAPGQGLEWMGWIYFASGNSEYNQKFTGRVTMTRDTSSSTAYMELSSLRSEDTAVYFCASLYDYDWYFDVWGQGTMVTVSSGGGGSGGGGSGGGGSDIVMTQTPLSLSVTPGEPASISCKSSQSLVHSNGNTYLHWYLQKPGQSPQLLIYKVSNRFSGVPDRFSGSGSGADFTLKISRVEAEDVGVYYCAETSHVPWTFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1370 - protein, 490 aa, Artificial Sequence
  source: /note="Description of Artificial Sequence: Synthetic Chimeric Antigen Receptor sequence"
MALPVTALLLPLALLLHAARPQVQLVQSGGGLVKPGGSLRLSCAASGFTFSDYYMSWIRQAPGKGLEWVSYISSSGNTIYYADSVKGRFTISRDNAKNSLYLQMNSLRAEDTAVYYCARSTMVREDYWGQGTLVTVSSASGGGGSGGRASGGGGSDIVLTQSPLSLPVTLGQPASISCKSSESLVHNSGKTYLNWFHQRPGQSPRRLIYEVSNRDSGVPDRFTGSGSGTDFTLKISRVEAEDVGVYYCMQGTHWPGIFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1371 - protein, 491 aa, Artificial Sequence
  source: /note="Description of Artificial Sequence: Synthetic Chimeric Antigen Receptor sequence"
GGGGSCPYSNPSLCSGGGGSGGGGSEVQLLESGGGLVQPGGSLRLSCAASGFTFSSYAMNWVRQAPGKGLEWVSAILSSGGSTYYADSVKGRFTISRDNSKNTLYLQMNSLRAEDTAVYYCARYWPMDIWGQGTLVTVSSGGSCPYSNPSLCSGGSEIVLTQSPGTLSLSPGERATLSCRGGQSVSSSYLAWYQQKPGQAPRLLMYDASIRATGIPDRFSGSGSGTDFTLTISRLEPEDFAVYYCQQYQSWPLTFGQGTKVEIKSDPTTTPAPRPPTPAPTIASQPLSLRPEACRPAAGGAVHTRGLDFACDIYIWAPLAGTCGVLLLSLVITLYCRRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRE

SEQ ID NO: 1372 - protein, 491 aa, Artificial Sequence
  source: /note="Description of Artificial Sequence: Synthetic Chimeric Antigen Receptor sequence"
QVQLVQSGAEVKKPGASVKVSCKASGYSFPDYYINWVRQAPGQGLEWMGWIYFASGNSEYNQKFTGRVTMTRDTSSSTAYMELSSLRSEDTAVYFCASLYDYDWYFDVWGQGTMVTVSSGGGGSGGGGSGGGGSDIVMTQTPLSLSVTPGEPASISCKSSQSLVHSNGNTYLHWYLQKPGQSPQLLIYKVSNRFSGVPDRFSGSGSGADFTLKISRVEAEDVGVYYCAETSHVPWTFGQGTKLEIKGSGGGGSCPYSNPSLCSGGGGSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1373 - protein, 492 aa, Artificial Sequence
  source: /note="Description of Artificial Sequence: Synthetic Chimeric Antigen Receptor sequence"
MALPVTALLLPLALLLHAARPEVQLVETGGGLVQPGGSLRLSCAASGFTFSSYAMSWVRQAPGKGLEWVSAISGSGGSTYYADSVKGRFTISRDNSKNTLYLQMNTLKAEDTAVYYCARATYKRELRYYYGMDVWGQGTTVTVSSGGGGSGGGGSGGGGSEIVLTQSPSTLSLSPGESATLSCRASQSVSTTFLAWYQQKPGQAPRLLIYGSSNRATGIPDRFSGSGSGTDFTLTIRRLEPEDFAVYYCQQYHSSPSWTFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1374 - protein, 492 aa, Artificial Sequence
  source: /note="Description of Artificial Sequence: Synthetic Chimeric Antigen Receptor sequence"
MALPVTALLLPLALLLHAARPEVQLVETGGGLVQPGGSLRLSCAASGFTFSSYAMSWVRQAPGKGLEWVSAISGSGGSTYYADSVKGRFTMSRENDKNSVFLQMNSLRVEDTGVYYCARANYKRELRYYYGMDVWGQGTMVTVSSGGGGSGGGGSGGGGSEIVMTQSPGTLSLSPGESATLSCRASQRVASNYLAWYQHKPGQAPSLLISGASSRATGVPDRFSGSGSGTDFTLAISRLEPEDSAVYYCQHYDSSPSWTFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1375 - protein, 493 aa, Artificial Sequence
  source: /note="Description of Artificial Sequence: Synthetic Chimeric Antigen Receptor sequence"
MALPVTALLLPLALLLHAARPDIVLTQSPASLAMSLGERATISCRASESVSVIGAHLIHWYQQKPGQPPKLLIYLASNLETGVPARFSGSGSGTDFTLTISRVQAEDAAIYSCLQSRIFPRTFGQGTKLEIKGSTSGSGKPGSGEGSTKGQIQLVQSGSELKKPGESVKISCKASGYTFTDYSINWVKQAPGQGLKWMGWINTETREPAYAYDFRGRFVFSLDTSASTAYLQISSLKAEDTAVYFCALDYSYAMDYWGQGTLVTVSSAAATTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1376 - protein, 493 aa, Artificial Sequence
  source: /note="Description of Artificial Sequence: Synthetic Chimeric Antigen Receptor sequence"
MALPVTALLLPLALLLHAARPDIVLTQSPASLAMSLGERATISCRASESVSVIGAHLIHWYQQKPGQPPKLLIYLASNLETGVPARFSGSGSGTDFTLTISRVQAEDAAIYSCLQSRIFPRTFGQGTKLEIKGSTSGSGKPGSGEGSTKGQVQLVQSGSELKKPGASVKVSCKASGYTFTDYSINWVRQAPGQGLEWMGWINTETREPAYAYDFRGRFVFSLDTSVSTAYLQISSLKAEDTAVYYCARDYSYAMDYWGQGTLVTVSSAAATTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1377 - protein, 493 aa, Artificial Sequence
  source: /note="Description of Artificial Sequence: Synthetic Chimeric Antigen Receptor sequence"
MALPVTALLLPLALLLHAARPDIVLTQSPASLAMSLGERATISCRASESVSVIGAHLIHWYQQKPGQPPKLLIYLASNLETGVPARFSGSGSGTDFTLTISRVQAEDAAIYSCLQSRIFPRTFGQGTKLEIKGSTSGSGKPGSGEGSTKGQVQLVQSGSELKKPGESVKISCKASGYTFTDYSINWVKQAPGQGLKWMGWINTETREPAYAYDFRGRFVFSLDTSASTAYLQISSLKAEDTAVYFCALDYSYAMDYWGQGTLVTVSSAAATTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1378 - protein, 493 aa, Artificial Sequence
  source: /note="Description of Artificial Sequence: Synthetic Chimeric Antigen Receptor sequence"
MALPVTALLLPLALLLHAARPDIVLTQSPASLAMSLGERATISCRASESVSVIGAHLIHWYQQKPGQPPKLLIYLASNLETGVPARFSGSGSGTDFTLTISRVQAEDAAIYSCLQSRIFPRTFGQGTKLEIKGSTSGSGKPGSGEGSTKGQVQLVQSGSELKKPGESVKISCKASGYTFTDYSINWVRQAPGQGLEWMGWINTETREPAYAYDFRGRFVFSLDTSASTAYLQISSLKAEDTAVYFCALDYSYAMDYWGQGTLVTVSSAAATTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1379 - protein, 493 aa, Artificial Sequence
  source: /note="Description of Artificial Sequence: Synthetic Chimeric Antigen Receptor sequence"
MALPVTALLLPLALLLHAARPDIVLTQSPASLAMSLGERATISCRASESVSVIGAHLIHWYQQKPGQPPKLLIYLASNLETGVPARFSGSGSGTDFTLTISRVQAEDAAIYSCLQSRIFPRTFGQGTKLEIKGSTSGSGKPGSGEGSTKGQVQLVQSGSELKKPGESVKVSCKASGYTFTDYSINWVRQAPGQGLEWMGWINTETREPAYAYDFRGRFVFSLDTSVSTAYLQISSLKAEDTAVYYCALDYSYAMDYWGQGTLVTVSSAAATTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1380 - protein, 493 aa, Artificial Sequence
  source: /note="Description of Artificial Sequence: Synthetic Chimeric Antigen Receptor sequence"
MALPVTALLLPLALLLHAARPDIVLTQSPASLAVSLGERATINCRASESVSVIGAHLIHWYQQKPGQPPKLLIYLASNLETGVPARFSGSGSGTDFTLTISSLQAEDAAIYSCLQSRIFPRTFGQGTKLEIKGSTSGSGKPGSGEGSTKGQIQLVQSGSELKKPGESVKISCKASGYTFTDYSINWVKQAPGQGLKWMGWINTETREPAYAYDFRGRFVFSLDTSASTAYLQISSLKAEDTAVYFCALDYSYAMDYWGQGTLVTVSSAAATTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1381 - protein, 493 aa, Artificial Sequence
  source: /note="Description of Artificial Sequence: Synthetic Chimeric Antigen Receptor sequence"
MALPVTALLLPLALLLHAARPDIVLTQSPASLAVSLGERATINCRASESVSVIGAHLIHWYQQKPGQPPKLLIYLASNLETGVPARFSGSGSGTDFTLTISSLQAEDAAIYSCLQSRIFPRTFGQGTKLEIKGSTSGSGKPGSGEGSTKGQVQLVQSGSELKKPGASVKVSCKASGYTFTDYSINWVRQAPGQGLEWMGWINTETREPAYAYDFRGRFVFSLDTSVSTAYLQISSLKAEDTAVYYCARDYSYAMDYWGQGTLVTVSSAAATTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1382 - protein, 493 aa, Artificial Sequence
  source: /note="Description of Artificial Sequence: Synthetic Chimeric Antigen Receptor sequence"
MALPVTALLLPLALLLHAARPDIVLTQSPASLAVSLGERATINCRASESVSVIGAHLIHWYQQKPGQPPKLLIYLASNLETGVPARFSGSGSGTDFTLTISSLQAEDAAIYSCLQSRIFPRTFGQGTKLEIKGSTSGSGKPGSGEGSTKGQVQLVQSGSELKKPGESVKISCKASGYTFTDYSINWVKQAPGQGLKWMGWINTETREPAYAYDFRGRFVFSLDTSASTAYLQISSLKAEDTAVYFCALDYSYAMDYWGQGTLVTVSSAAATTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1383 - protein, 493 aa, Artificial Sequence
  source: /note="Description of Artificial Sequence: Synthetic Chimeric Antigen Receptor sequence"
MALPVTALLLPLALLLHAARPDIVLTQSPASLAVSLGERATINCRASESVSVIGAHLIHWYQQKPGQPPKLLIYLASNLETGVPARFSGSGSGTDFTLTISSLQAEDAAIYSCLQSRIFPRTFGQGTKLEIKGSTSGSGKPGSGEGSTKGQVQLVQSGSELKKPGESVKISCKASGYTFTDYSINWVRQAPGQGLEWMGWINTETREPAYAYDFRGRFVFSLDTSASTAYLQISSLKAEDTAVYFCALDYSYAMDYWGQGTLVTVSSAAATTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1384 - protein, 493 aa, Artificial Sequence
  source: /note="Description of Artificial Sequence: Synthetic Chimeric Antigen Receptor sequence"
MALPVTALLLPLALLLHAARPDIVLTQSPASLAVSLGERATINCRASESVSVIGAHLIHWYQQKPGQPPKLLIYLASNLETGVPARFSGSGSGTDFTLTISSLQAEDAAIYSCLQSRIFPRTFGQGTKLEIKGSTSGSGKPGSGEGSTKGQVQLVQSGSELKKPGESVKVSCKASGYTFTDYSINWVRQAPGQGLEWMGWINTETREPAYAYDFRGRFVFSLDTSVSTAYLQISSLKAEDTAVYYCALDYSYAMDYWGQGTLVTVSSAAATTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1385 - protein, 493 aa, Artificial Sequence
  source: /note="Description of Artificial Sequence: Synthetic Chimeric Antigen Receptor sequence"
MALPVTALLLPLALLLHAARPDIVLTQSPASLAVSLGERATINCRASESVSVIGAHLIHWYQQKPGQPPKLLIYLASNLETGVPARFSGSGSGTDFTLTISSLQAEDAAIYYCLQSRIFPRTFGQGTKLEIKGSTSGSGKPGSGEGSTKGQIQLVQSGSELKKPGESVKISCKASGYTFTDYSINWVKQAPGQGLKWMGWINTETREPAYAYDFRGRFVFSLDTSASTAYLQISSLKAEDTAVYFCALDYSYAMDYWGQGTLVTVSSAAATTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1386 - protein, 493 aa, Artificial Sequence
  source: /note="Description of Artificial Sequence: Synthetic Chimeric Antigen Receptor sequence"
MALPVTALLLPLALLLHAARPDIVLTQSPASLAVSLGERATINCRASESVSVIGAHLIHWYQQKPGQPPKLLIYLASNLETGVPARFSGSGSGTDFTLTISSLQAEDAAIYYCLQSRIFPRTFGQGTKLEIKGSTSGSGKPGSGEGSTKGQVQLVQSGSELKKPGASVKVSCKASGYTFTDYSINWVRQAPGQGLEWMGWINTETREPAYAYDFRGRFVFSLDTSVSTAYLQISSLKAEDTAVYYCARDYSYAMDYWGQGTLVTVSSAAATTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1387 - protein, 493 aa, Artificial Sequence
  source: /note="Description of Artificial Sequence: Synthetic Chimeric Antigen Receptor sequence"
MALPVTALLLPLALLLHAARPDIVLTQSPASLAVSLGERATINCRASESVSVIGAHLIHWYQQKPGQPPKLLIYLASNLETGVPARFSGSGSGTDFTLTISSLQAEDAAIYYCLQSRIFPRTFGQGTKLEIKGSTSGSGKPGSGEGSTKGQVQLVQSGSELKKPGESVKISCKASGYTFTDYSINWVKQAPGQGLKWMGWINTETREPAYAYDFRGRFVFSLDTSASTAYLQISSLKAEDTAVYFCALDYSYAMDYWGQGTLVTVSSAAATTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1388 - protein, 493 aa, Artificial Sequence
  source: /note="Description of Artificial Sequence: Synthetic Chimeric Antigen Receptor sequence"
MALPVTALLLPLALLLHAARPDIVLTQSPASLAVSLGERATINCRASESVSVIGAHLIHWYQQKPGQPPKLLIYLASNLETGVPARFSGSGSGTDFTLTISSLQAEDAAIYYCLQSRIFPRTFGQGTKLEIKGSTSGSGKPGSGEGSTKGQVQLVQSGSELKKPGESVKISCKASGYTFTDYSINWVRQAPGQGLEWMGWINTETREPAYAYDFRGRFVFSLDTSASTAYLQISSLKAEDTAVYFCALDYSYAMDYWGQGTLVTVSSAAATTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1389 - protein, 493 aa, Artificial Sequence
  source: /note="Description of Artificial Sequence: Synthetic Chimeric Antigen Receptor sequence"
MALPVTALLLPLALLLHAARPDIVLTQSPASLAVSLGERATINCRASESVSVIGAHLIHWYQQKPGQPPKLLIYLASNLETGVPARFSGSGSGTDFTLTISSLQAEDAAIYYCLQSRIFPRTFGQGTKLEIKGSTSGSGKPGSGEGSTKGQVQLVQSGSELKKPGESVKVSCKASGYTFTDYSINWVRQAPGQGLEWMGWINTETREPAYAYDFRGRFVFSLDTSVSTAYLQISSLKAEDTAVYYCALDYSYAMDYWGQGTLVTVSSAAATTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1390 - protein, 493 aa, Artificial Sequence
  source: /note="Description of Artificial Sequence: Synthetic Chimeric Antigen Receptor sequence"
MALPVTALLLPLALLLHAARPQVQLVQSGAEVKKPGASVKVSCKASGYSFPDYYINWVRQAPGQGLEWMGWIYFASGNSEYNQKFTGRVTMTRDTSINTAYMELSSLTSEDTAVYFCASLYDYDWYFDVWGQGTMVTVSSGGGGSGGGGSGGGGSDIVMTQTPLSLSVTPGQPASISCKSSQSLVHSNGNTYLHWYLQKPGQSPQLLIYKVSNRFSGVPDRFSGSGSGTDFTLKISRVEAEDVGIYYCSQSSIYPWTFGQGTKLEIKTTTPAPRPPTPAPTIASQPLSLRPEACRPAAGGAVHTRGLDFACDIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1391 - protein, 493 aa, Artificial Sequence
  source: /note="Description of Artificial Sequence: Synthetic Chimeric Antigen Receptor sequence"
MALPVTALLLPLALLLHAARPQVQLVQSGAEVKKPGASVKVSCKASGYSFPDYYINWVRQAPGQGLEWMGWIYFASGNSEYNQKFTGRVTMTRDTSSSTAYMELSSLRSEDTAVYFCASLYDYDWYFDVWGQGTMVTVSSGGGGSGGGGSGGGGSDIVMTQTPLSLSVTPGEPASISCKSSQSLVHSNGNTYLHWYLQKPGQSPQLLIYKVSNRFSGVPDRFSGSGSGADFTLKISRVEAEDVGVYYCAETSHVPWTFGQGTKLEIKTTTPAPRPPTPAPTIASQPLSLRPEACRPAAGGAVHTRGLDFACDIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1392 - protein, 496 aa, Artificial Sequence
  source: /note="Description of Artificial Sequence: Synthetic Chimeric Antigen Receptor sequence"
EVQLLESGGGLVQPGGSLRLSCAASGFTFSSYAMNWVRQAPGKGLEWVSAILSSGGSTYYADSVKGRFTISRDNSKNTLYLQMNSLRAEDTAVYYCARYWPMDIWGQGTLVTVSSGGGGGSCPYSNPSLCSGGGGGSEIVLTQSPGTLSLSPGERATLSCRGGQSVSSSYLAWYQQKPGQAPRLLMYDASIRATGIPDRFSGSGSGTDFTLTISRLEPEDFAVYYCQQYQSWPLTFGQGTKVEIKSDPGSGGGGSCPYSNPSLCSGGGGSAPTTTPAPRPPTPAPTIASQPLSLRPEACRPAAGGAVHTRGLDFACDIYIWAPLAGTCGVLLLSLVITLYCRRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRE

SEQ ID NO: 1393 - protein, 497 aa, Artificial Sequence
  source: /note="Description of Artificial Sequence: Synthetic Chimeric Antigen Receptor sequence"
GGGGSCPYSNPSLCSGGGGSGGGGSEVQLLESGGGLVQPGGSLRLSCAASGFTFSSYAMNWVRQAPGKGLEWVSAILSSGGSTYYADSVKGRFTISRDNSKNTLYLQMNSLRAEDTAVYYCARYWPMDIWGQGTLVTVSSGGGGGSCPYSNPSLCSGGGGGSEIVLTQSPGTLSLSPGERATLSCRGGQSVSSSYLAWYQQKPGQAPRLLMYDASIRATGIPDRFSGSGSGTDFTLTISRLEPEDFAVYYCQQYQSWPLTFGQGTKVEIKSDPTTTPAPRPPTPAPTIASQPLSLRPEACRPAAGGAVHTRGLDFACDIYIWAPLAGTCGVLLLSLVITLYCRRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRE

SEQ ID NO: 1394 - protein, 498 aa, Artificial Sequence
  source: /note="Description of Artificial Sequence: Synthetic Chimeric Antigen Receptor sequence"
EVQLLESGGGLVQPGGSLRLSCAASGFTFSSYAMNWVRQAPGKGLEWVSAILSSGGSTYYADSVKGRFTISRDNSKNTLYLQMNSLRAEDTAVYYCARYWPMDIWGQGTLVTVSSGGGGSGGGGSGGGGSEIVLTQSPGTLSLSPGERATLSCRGGQSVSSSYLAWYQQKPGQAPRLLMYDASIRATGIPDRFSGSGSGTDFTLTISRLEPEDFAVYYCQQYQSWPLTFGQGTKVEIKSDPGSGGGGSCPYSNPSLCSGGGGSCPYSNPSLCAPTTTPAPRPPTPAPTIASQPLSLRPEACRPAAGGAVHTRGLDFACDIYIWAPLAGTCGVLLLSLVITLYCRRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRE

SEQ ID NO: 1395 - protein, 500 aa, Artificial Sequence
  source: /note="Description of Artificial Sequence: Synthetic Chimeric Antigen Receptor sequence"
GGGGSCPYSNPSLCSGGGGSCPYSNPSLCSGGGGSEVQLLESGGGLVQPGGSLRLSCAASGFTFSSYAMNWVRQAPGKGLEWVSAILSSGGSTYYADSVKGRFTISRDNSKNTLYLQMNSLRAEDTAVYYCARYWPMDIWGQGTLVTVSSGGGGSGGGGSGGGGSEIVLTQSPGTLSLSPGERATLSCRGGQSVSSSYLAWYQQKPGQAPRLLMYDASIRATGIPDRFSGSGSGTDFTLTISRLEPEDFAVYYCQQYQSWPLTFGQGTKVEIKSDPTTTPAPRPPTPAPTIASQPLSLRPEACRPAAGGAVHTRGLDFACDIYIWAPLAGTCGVLLLSLVITLYCRRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRE

SEQ ID NO: 1396 - protein, 500 aa, Artificial Sequence
  source: /note="Description of Artificial Sequence: Synthetic Chimeric Antigen Receptor sequence"
QVQLVQSGAEVKKPGASVKVSCKASGYSFPDYYINWVRQAPGQGLEWMGWIYFASGNSEYNQKFTGRVTMTRDTSSSTAYMELSSLRSEDTAVYFCASLYDYDWYFDVWGQGTMVTVSSGGGGSGGGGSGGGGSDIVMTQTPLSLSVTPGEPASISCKSSQSLVHSNGNTYLHWYLQKPGQSPQLLIYKVSNRFSGVPDRFSGSGSGADFTLKISRVEAEDVGVYYCAETSHVPWTFGQGTKLEIKGSGGGGSCPYSNPSLCSGGGGSCPYSNPSLCTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1397 - protein, 502 aa, Artificial Sequence
  source: /note="Description of Artificial Sequence: Synthetic Chimeric Antigen Receptor sequence"
MALPVTALLLPLALLLHAARPDIVLTQSPPSLAMSLGKRATISCRASESVTILGSHLIHWYQQKPGQPPTLLIQLASNVQTGVPARFSGSGSRTDFTLTIDPVEEDDVAVYYCLQSRTIPRTFGGGTKLEIKGSTSGSGKPGSGEGSTKGQIQLVQSGPELKKPGETVKISCKASGYTFTDYSINWVKRAPGKGLKWMGWINTETREPAYAYDFRGRFAFSLETSASTAYLQINNLKYEDTATYFCALDYSYAMDYWGQGTSVTVSSAAAFVPVFLPAKPTTTPAPRPPTPAPTIASQPLSLRPEACRPAAGGAVHTRGLDFACDIYIWAPLAGTCGVLLLSLVITLYCNHRNRRDQRLPPDAHKPPGGGSFRTPIQEEQADAHSTLAKIRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1398 - protein, 503 aa, Artificial Sequence
  source: /note="Description of Artificial Sequence: Synthetic Chimeric Antigen Receptor sequence"
MALPVTALLLPLALLLHAARPDIVLTQSPPSLAMSLGKRATISCRASESVTILGSHLIHWYQQKPGQPPTLLIQLASNVQTGVPARFSGSGSRTDFTLTIDPVEEDDVAVYYCLQSRTIPRTFGGGTKLEIKGSTSGSGKPGSGEGSTKGQIQLVQSGPELKKPGETVKISCKASGYTFTDYSINWVKRAPGKGLKWMGWINTETREPAYAYDFRGRFAFSLETSASTAYLQINNLKYEDTATYFCALDYSYAMDYWGQGTSVTVSSFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1399 - protein, 503 aa, Artificial Sequence
  source: /note="Description of Artificial Sequence: Synthetic Chimeric Antigen Receptor sequence"
MALPVTALLLPLALLLHAARPDIVLTQSPPSLAMSLGKRATISCRASESVTILGSHLIYWYQQKPGQPPTLLIQLASNVQTGVPARFSGSGSRTDFTLTIDPVEEDDVAVYYCLQSRTIPRTFGGGTKLEIKGSTSGSGKPGSGEGSTKGQIQLVQSGPELKKPGETVKISCKASGYTFRHYSMNWVKQAPGKGLKWMGRINTESGVPIYADDFKGRFAFSVETSASTAYLVINNLKDEDTASYFCSNDYLYSLDFWGQGTALTVSSFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1400 - protein, 503 aa, Artificial Sequence
  source: /note="Description of Artificial Sequence: Synthetic Chimeric Antigen Receptor sequence"
MALPVTALLLPLALLLHAARPDIVLTQSPPSLAMSLGKRATISCRASESVTILGSHLIYWYQQKPGQPPTLLIQLASNVQTGVPARFSGSGSRTDFTLTIDPVEEDDVAVYYCLQSRTIPRTFGGGTKLEIKGSTSGSGKPGSGEGSTKGQIQLVQSGPELKKPGETVKISCKASGYTFTHYSMNWVKQAPGKGLKWMGRINTETGEPLYADDFKGRFAFSLETSASTAYLVINNLKNEDTATFFCSNDYLYSCDYWGQGTTLTVSSFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1401 - protein, 504 aa, Artificial Sequence
  source: /note="Description of Artificial Sequence: Synthetic Chimeric Antigen Receptor sequence"
EVQLLESGGGLVQPGGSLRLSCAASGFTFSSYAMNWVRQAPGKGLEWVSAILSSGGSTYYADSVKGRFTISRDNSKNTLYLQMNSLRAEDTAVYYCARYWPMDIWGQGTLVTVSSGGGGSGGGGSGGGGSEIVLTQSPGTLSLSPGERATLSCRGGQSVSSSYLAWYQQKPGQAPRLLMYDASIRATGIPDRFSGSGSGTDFTLTISRLEPEDFAVYYCQQYQSWPLTFGQGTKVEIKSDPGSGGGGSCPYSNPSLCSGGGGSCPYSNPSLCSGGGGSAPTTTPAPRPPTPAPTIASQPLSLRPEACRPAAGGAVHTRGLDFACDIYIWAPLAGTCGVLLLSLVITLYCRRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRE

SEQ ID NO: 1402 - protein, 506 aa, Artificial Sequence
  source: /note="Description of Artificial Sequence: Synthetic Chimeric Antigen Receptor sequence"
MALPVTALLLPLALLLHAARPDIVLTQSPPSLAMSLGKRATISCRASESVTILGSHLIHWYQQKPGQPPTLLIQLASNVQTGVPARFSGSGSRTDFTLTIDPVEEDDVAVYYCLQSRTIPRTFGGGTKLEIKGSTSGSGKPGSGEGSTKGQIQLVQSGPELKKPGETVKISCKASGYTFTDYSINWVKRAPGKGLKWMGWINTETREPAYAYDFRGRFAFSLETSASTAYLQINNLKYEDTATYFCALDYSYAMDYWGQGTSVTVSSAAAFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1403 - protein, 506 aa, Artificial Sequence
  source: /note="Description of Artificial Sequence: Synthetic Chimeric Antigen Receptor sequence"
QVQLVQSGAEVKKPGASVKVSCKASGYSFPDYYINWVRQAPGQGLEWMGWIYFASGNSEYNQKFTGRVTMTRDTSSSTAYMELSSLRSEDTAVYFCASLYDYDWYFDVWGQGTMVTVSSGGGGSGGGGSGGGGSDIVMTQTPLSLSVTPGEPASISCKSSQSLVHSNGNTYLHWYLQKPGQSPQLLIYKVSNRFSGVPDRFSGSGSGADFTLKISRVEAEDVGVYYCAETSHVPWTFGQGTKLEIKGSGGGGSCPYSNPSLCSGGGGSCPYSNPSLCSGGGGSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1404 - protein, 507 aa, Artificial Sequence
  source: /note="Description of Artificial Sequence: Synthetic Chimeric Antigen Receptor sequence"
MLLLVTSLLLCELPHPAFLLIPDIVLTQSPPSLAMSLGKRATISCRASESVTILGSHLIHWYQQKPGQPPTLLIQLASNVQTGVPARFSGSGSRTDFTLTIDPVEEDDVAVYYCLQSRTIPRTFGGGTKLEIKGSTSGSGKPGSGEGSTKGQIQLVQSGPELKKPGETVKISCKASGYTFTDYSINWVKRAPGKGLKWMGWINTETREPAYAYDFRGRFAFSLETSASTAYLQINNLKYEDTATYFCALDYSYAMDYWGQGTSVTVSSAAAFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1405 - protein, 512 aa, Artificial Sequence
  source: /note="Description of Artificial Sequence: Synthetic Chimeric Antigen Receptor sequence"
MALPVTALLLPLALLLHAARPDIVLTQSPPSLAMSLGKRATISCRASESVTILGSHLIHWYQQKPGQPPTLLIQLASNVQTGVPARFSGSGSRTDFTLTIDPVEEDDVAVYYCLQSRTIPRTFGGGTKLEIKGSTSGSGKPGSGEGSTKGQIQLVQSGPELKKPGETVKISCKASGYTFTDYSINWVKRAPGKGLKWMGWINTETREPAYAYDFRGRFAFSLETSASTAYLQINNLKYEDTATYFCALDYSYAMDYWGQGTSVTVSSAAAFVPVFLPAKPTTTPAPRPPTPAPTIASQPLSLRPEACRPAAGGAVHTRGLDFACDIYIWAPLAGTCGVLLLSLVITLYCNHRNRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1406 - protein, 513 aa, Artificial Sequence
  source: /note="Description of Artificial Sequence: Synthetic Chimeric Antigen Receptor sequence"
EVQLLESGGGLVQPGGSLRLSCAASGFTFSSYAMNWVRQAPGKGLEWVSAILSSGGSTYYADSVKGRFTISRDNSKNTLYLQMNSLRAEDTAVYYCARYWPMDIWGQGTLVTVSSGGGGSGGGGSGGGGSEIVLTQSPGTLSLSPGERATLSCRGGQSVSSSYLAWYQQKPGQAPRLLMYDASIRATGIPDRFSGSGSGTDFTLTISRLEPEDFAVYYCQQYQSWPLTFGQGTKVEIKSDPGSGGGGSCPYSNPSLCSGGGGSCPYSNPSLCSGGGGSCPYSNPSLCAPTTTPAPRPPTPAPTIASQPLSLRPEACRPAAGGAVHTRGLDFACDIYIWAPLAGTCGVLLLSLVITLYCRRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRE

SEQ ID NO: 1407 - protein, 514 aa, Artificial Sequence
  source: /note="Description of Artificial Sequence: Synthetic Chimeric Antigen Receptor sequence"
GGGGSCPYSNPSLCSGGGGSGGGGSEVQLLESGGGLVQPGGSLRLSCAASGFTFSSYAMNWVRQAPGKGLEWVSAILSSGGSTYYADSVKGRFTISRDNSKNTLYLQMNSLRAEDTAVYYCARYWPMDIWGQGTLVTVSSGGGGSGGGGSGGGGSEIVLTQSPGTLSLSPGERATLSCRGGQSVSSSYLAWYQQKPGQAPRLLMYDASIRATGIPDRFSGSGSGTDFTLTISRLEPEDFAVYYCQQYQSWPLTFGQGTKVEIKSDPGSGGGGSCPYSNPSLCSGGGGSAPTTTPAPRPPTPAPTIASQPLSLRPEACRPAAGGAVHTRGLDFACDIYIWAPLAGTCGVLLLSLVITLYCRRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRE

SEQ ID NO: 1408 - protein, 515 aa, Artificial Sequence
  source: /note="Description of Artificial Sequence: Synthetic Chimeric Antigen Receptor sequence"
GGGGSCPYSNPSLCSGGGGSGGGGSEVQLLESGGGLVQPGGSLRLSCAASGFTFSSYAMNWVRQAPGKGLEWVSAILSSGGSTYYADSVKGRFTISRDNSKNTLYLQMNSLRAEDTAVYYCARYWPMDIWGQGTLVTVSSGGSCPYSNPSLCSGGSEIVLTQSPGTLSLSPGERATLSCRGGQSVSSSYLAWYQQKPGQAPRLLMYDASIRATGIPDRFSGSGSGTDFTLTISRLEPEDFAVYYCQQYQSWPLTFGQGTKVEIKSDPGSGGGGSCPYSNPSLCSGGGGSAPTTTPAPRPPTPAPTIASQPLSLRPEACRPAAGGAVHTRGLDFACDIYIWAPLAGTCGVLLLSLVITLYCRRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRE

SEQ ID NO: 1409 - protein, 521 aa, Artificial Sequence
  source: /note="Description of Artificial Sequence: Synthetic Chimeric Antigen Receptor sequence"
GGGGSCPYSNPSLCSGGGGSGGGGSEVQLLESGGGLVQPGGSLRLSCAASGFTFSSYAMNWVRQAPGKGLEWVSAILSSGGSTYYADSVKGRFTISRDNSKNTLYLQMNSLRAEDTAVYYCARYWPMDIWGQGTLVTVSSGGGGGSCPYSNPSLCSGGGGGSEIVLTQSPGTLSLSPGERATLSCRGGQSVSSSYLAWYQQKPGQAPRLLMYDASIRATGIPDRFSGSGSGTDFTLTISRLEPEDFAVYYCQQYQSWPLTFGQGTKVEIKSDPGSGGGGSCPYSNPSLCSGGGGSAPTTTPAPRPPTPAPTIASQPLSLRPEACRPAAGGAVHTRGLDFACDIYIWAPLAGTCGVLLLSLVITLYCRRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRE

SEQ ID NO: 1410 - protein, 522 aa, Artificial Sequence
  source: /note="Description of Artificial Sequence: Synthetic Chimeric Antigen Receptor sequence"
EVQLLESGGGLVQPGGSLRLSCAASGFTFSSYAMNWVRQAPGKGLEWVSAILSSGGSTYYADSVKGRFTISRDNSKNTLYLQMNSLRAEDTAVYYCARYWPMDIWGQGTLVTVSSGGGGSGGGGSGGGGSEIVLTQSPGTLSLSPGERATLSCRGGQSVSSSYLAWYQQKPGQAPRLLMYDASIRATGIPDRFSGSGSGTDFTLTISRLEPEDFAVYYCQQYQSWPLTFGQGTKVEIKSDPGSGGGGSCPYSNPSLCSGGGGSELPTQGTFSNVSTNVSPAKPTTTACPYSNPSLCAPTTTPAPRPPTPAPTIASQPLSLRPEACRPAAGGAVHTRGLDFACDIYIWAPLAGTCGVLLLSLVITLYCRRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRE

SEQ ID NO: 1411 - protein, 523 aa, Artificial Sequence
  source: /note="Description of Artificial Sequence: Synthetic Chimeric Antigen Receptor sequence"
EVQLLESGGGLVQPGGSLRLSCAASGFTFSSYAMNWVRQAPGKGLEWVSAILSSGGSTYYADSVKGRFTISRDNSKNTLYLQMNSLRAEDTAVYYCARYWPMDIWGQGTLVTVSSGGSCPYSNPSLCSGGSEIVLTQSPGTLSLSPGERATLSCRGGQSVSSSYLAWYQQKPGQAPRLLMYDASIRATGIPDRFSGSGSGTDFTLTISRLEPEDFAVYYCQQYQSWPLTFGQGTKVEIKSDPGSGGGGSCPYSNPSLCSGGGGSELPTQGTFSNVSTNVSPAKPTTTACPYSNPSLCAPTTTPAPRPPTPAPTIASQPLSLRPEACRPAAGGAVHTRGLDFACDIYIWAPLAGTCGVLLLSLVITLYCRRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRE

SEQ ID NO: 1412 - protein, 547 aa, Artificial Sequence
  source: /note="Description of Artificial Sequence: Synthetic Chimeric Antigen Receptor sequence"
GGGGSCPYSNPSLCSGGGGSGGGGSEVQLLESGGGLVQPGGSLRLSCAASGFTFSSYAMNWVRQAPGKGLEWVSAILSSGGSTYYADSVKGRFTISRDNSKNTLYLQMNSLRAEDTAVYYCARYWPMDIWGQGTLVTVSSGGGGSGGGGSGGGGSEIVLTQSPGTLSLSPGERATLSCRGGQSVSSSYLAWYQQKPGQAPRLLMYDASIRATGIPDRFSGSGSGTDFTLTISRLEPEDFAVYYCQQYQSWPLTFGQGTKVEIKSDPGSGGGGSCPYSNPSLCSGGGGSELPTQGTFSNVSTNVSPAKPTTTACPYSNPSLCAPTTTPAPRPPTPAPTIASQPLSLRPEACRPAAGGAVHTRGLDFACDIYIWAPLAGTCGVLLLSLVITLYCRRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRE

SEQ ID NO: 1413 - protein, 549 aa, Artificial Sequence
  source: /note="Description of Artificial Sequence: Synthetic Chimeric Antigen Receptor sequence"
MALPVTALLLPLALLLHAARPDIVLTQSPPSLAMSLGKRATISCRASESVTILGSHLIHWYQQKPGQPPTLLIQLASNVQTGVPARFSGSGSRTDFTLTIDPVEEDDVAVYYCLQSRTIPRTFGGGTKLEIKGSTSGSGKPGSGEGSTKGQIQLVQSGPELKKPGETVKISCKASGYTFTDYSINWVKRAPGKGLKWMGWINTETREPAYAYDFRGRFAFSLETSASTAYLQINNLKYEDTATYFCALDYSYAMDYWGQGTSVTVSSAAAFVPVFLPAKPTTTPAPRPPTPAPTIASQPLSLRPEACRPAAGGAVHTRGLDFACDIYIWAPLAGTCGVLLLSLVITLYCNHRNRFSVVKRGRKKLLYIFKQPFMRPVQTTQEEDGCSCRFPEEEEGGCELRRDQRLPPDAHKPPGGGSFRTPIQEEQADAHSTLAKIRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1414 - protein, 610 aa, Artificial Sequence
  source: /note="Description of Artificial Sequence: Synthetic Chimeric Antigen Receptor sequence"
METDTLLLWVLLLWVPGSTGSVLHLVPINATSKDDSDVTEVMWQPALRRGRGLQAQGYGVRIQDAGVYLLYSQVLFQDVTFTMGQWSREGQGRQETLFRCIRSMPSHPDRAYNSCYSAGVFHLHQGDILSVIIPRARAKLNLSPHGTFLGFVKLSGGGSDPAEPKSPDKTHTCPPCPAPPVAGPSVFLFPPKPKDTLMIARTPEVTCVWDVSHEDPEVKFNWYVDGVEVHNAKTKPREEQYNSTYRWSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKKDPKFWVLVVVGGVLACYSLLVTVAFIIFVRSKRSRLLHSDYMNMTPRRPGPTRKHYQPYAPPRDFAAYRSRDQRLPPDAHKPPGGGSFRTPIQEEQADAHSTLAKIRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1415 - protein, 630 aa, Artificial Sequence
  source: /note="Description of Artificial Sequence: Synthetic Chimeric Antigen Receptor sequence"
MGTSLLCWMALCLLGADHADGKPIPNPLLGLDSTSGGGGSVLHLVPINATSKDDSDVTEVMWQPALRRGRGLQAQGYGVRIQDAGVYLLYSQVLFQDVTFTMGQVVSREGQGRQETLFRCIRSMPSHPDRAYNSCYSAGVFHLHQGDILSVIIPRARAKLNLSPHGTFLGFVKLSGGGSDPAEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVHEALHNHYTQKSLSLSPGKKDPKFWVLWVGGVLACYSLLVTVAFIIFWVRSKRSRLLHSDYMNMTPRRPGPTRKHYQPYAPPRDFAAYRSRDQRLPPDAHKPPGGGSFRTPIQEEQADAHSTLAKIRVKFSRSADAPAYQQGQNQLYNELNLGRREEYDVLDKRRGRDPEGGKPRRKNPQEGLYNELQKDKMAEAYSEIGMKGERRRGKGHDGLYQGLSTATKDTYDALHMQALPPR

SEQ ID NO: 1416 - protein, 633 aa, Artificial Sequence
  source: /note="Description of Artificial Sequence: Synthetic Chimeric Antigen Receptor sequence"
MGTSLLCWMALCLLGADHADGKPIPNPLLGLDSTSGGGGSVLHLVPINATSKDDSDVTEVMWQPALRRGRGLQAQGYGVRIQDAGVYLLYSQVLFQDVTFTMGQVVSREGQGRQETLFRCIRSMPSHPDRAYNSCYSAGVEHLHQGDILSVIIPRARAKLNLSPHGTFLGFVKLSGGGSDPAEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKKDPKFWVLVVVGGVLACYSLLVTVAFIIFWVRSKRSRLLHSDYMNMTPRRPGPTRKHYQPYAPPRDFAAYRSRDQRLPPDAHKPPGGGSFRTPIQEEQADAHSTLAKIRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1417 - protein, 650 aa, Artificial Sequence
  source: /note="Description of Artificial Sequence: Synthetic Chimeric Antigen Receptor sequence"
QVQLQQSGPELVRPGTFVKISCKASGYTFTNYDINWVNQRPGQGLEWIGWIYPGDGSTKYNEKFKAKATLTADKSSSTAYLQLNNLTSENSAVYFCASGYEDAMDYWGQGTSVTVSSGGGGSGGGGSGGGGSDIKMTQSPSSMYASLGERVIINCKASQDINSYLSWFQQKPGKSPKTLIYRANRLVDGVPSRFSGSGSGQDYSLTISSLEYEDMGIYYCLQYDEFPLTFGAGTKLELKREPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALP

SEQ ID NO: 1418 - protein, 676 aa, Artificial Sequence
  source: /note="Description of Artificial Sequence: Synthetic Chimeric Antigen Receptor sequence"
MALPVTALLLPLALLLHAARPQVQLVQSGAEVKKPGASVKVSCKASGYSFPDYYINWVRQAPGQGLEWMGWIYFASGNSEYNQKFTGRVTMTRDTSINTAYMELSSLTSEDTAVYFCASLYDYDWYFDVWGQGTMVTVSSGGGGSGGGGSGGGGSDIVMTQTPLSLSVTPGQPASISCKSSQSLVHSNGNTYLHWYLQKPGQSPQLLIYKVSNRFSGVPDRFSGSGSGTDFTLKISRVEAEDVGIYYCSQSSIYPWTFGQGTKLEIKEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1419 - protein, 676 aa, Artificial Sequence
  source: /note="Description of Artificial Sequence: Synthetic Chimeric Antigen Receptor sequence"
MALPVTALLLPLALLLHAARPQVQLVQSGAEVKKPGASVKVSCKASGYSFPDYYINWVRQAPGQGLEWMGWIYFASGNSEYNQKFTGRVTMTRDTSSSTAYMELSSLRSEDTAVYFCASLYDYDWYFDVWGQGTMVTVSSGGGGSGGGGSGGGGSDIVMTQTPLSLSVTPGEPASISCKSSQSLVHSNGNTYLHWYLQKPGQSPQLLIYKVSNRFSGVPDRFSGSGSGADFTLKISRVEAEDVGVYYCAETSHVPWTFGQGTKLEIKEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1420 - protein, 679 aa, Artificial Sequence
  source: /note="Description of Artificial Sequence: Synthetic Chimeric Antigen Receptor sequence"
MALPVTALLLPLALLLHAARPQVQLVQSGAEVKKPGASVKVSCKASGYSFPDYYINWVRQAPGQGLEWMGWIYFASGNSEYNQKFTGRVTMTRDTSINTAYMELSSLTSEDTAVYFCASLYDYDWYFDVWGQGTMVTVSSGGGGSGGGGSGGGGSDIVMTQTPLSLSVTPGQPASISCKSSQSLVHSNGNTYLHWYLQKPGQSPQLLIYKVSNRFSGVPDRFSGSGSGTDFTLKISRVEAEDVGIYYCSQSSIYPWTFGQGTKLEIKEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1421 - protein, 679 aa, Artificial Sequence
  source: /note="Description of Artificial Sequence: Synthetic Chimeric Antigen Receptor sequence"
MALPVTALLLPLALLLHAARPQVQLVQSGAEVKKPGASVKVSCKASGYSFPDYYINWVRQAPGQGLEWMGWIYFASGNSEYNQKFTGRVTMTRDTSSSTAYMELSSLRSEDTAVYFCASLYDYDWYFDVWGQGTMVTVSSGGGGSGGGGSGGGGSDIVMTQTPLSLSVTPGEPASISCKSSQSLVHSNGNTYLHWYLQKPGQSPQLLIYKVSNRFSGVPDRFSGSGSGADFTLKISRVEAEDVGVYYCAETSHVPWTFGQGTKLEIKEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1422 - protein, 493 aa, Artificial Sequence
  source: /note="Description of Artificial Sequence: Synthetic Chimeric Antigen Receptor sequence"
MALPVTALLLPLALLLHAARPQVQLVQSGAEVRKTGASVKVSCKASGYIFDNFGINWVRQAPGQGLEWMGWINPKNNNTNYAQKFQGRVTITADESTNTAYMEVSSLRSEDTAVYYCARGPYYYQSYMDVWGQGTMVTVSSASGGGGSGGRASGGGGSDIVMTQTPLSLPVTPGEPASISCRSSQSLLHSNGYNYLNWYLQKPGQSPQLLIYLGSKRASGVPDRFSGSGSGTDFTLHITRVGAEDVGVYYCMQALQTPYTFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1423 - protein, 490 aa, Artificial Sequence
  source: /note="Description of Artificial Sequence: Synthetic Chimeric Antigen Receptor sequence"
MALPVTALLLPLALLLHAARPQVQLQESGGGLVQPGGSLRLSCAASGFTFSSDAMTWVRQAPGKGLEWVSVISGSGGTTYYADSVKGRFTISRDNSKNTLYLQMNSLRAEDTAVYYCAKLDSSGYYYARGPRYWGQGTLVTVSSASGGGGSGGRASGGGGSDIQLTQSPSSLSASVGDRVTITCRASQSISSYLNWYQQKPGKAPKLLIYGASTLASGVPARFSGSGSGTHFTLTINSLQSEDSATYYCQQSYKRASFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1424 - protein, 491 aa, Artificial Sequence
  source: /note="Description of Artificial Sequence: Synthetic Chimeric Antigen Receptor sequence"
MALPVTALLLPLALLLHAARPQVQLVQSGAEVKKPGASVKVSCKASGYTFSNYGITWVRQAPGQGLEWMGWISAYNGNTNYAQKFQGRVTMTRNTSISTAYMELSSLRSEDTAVYYCARGPYYYYMDVWGKGTMVTVSSASGGGGSGGRASGGGGSEIVMTQSPLSLPVTPGEPASISCRSSQSLLYSNGYNYVDWYLQKPGQSPQLLIYLGSNRASGVPDRFSGSGSGTDFKLQISRVEAEDVGIYYCMQGRQFPYSFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1425 - protein, 490 aa, Artificial Sequence
  source: /note="Description of Artificial Sequence: Synthetic Chimeric Antigen Receptor sequence"
MALPVTALLLPLALLLHAARPQVQLVESGGGLVQPGRSLRLSCAASGFTFSNYAMSWVRQAPGKGLGWVSGISRSGENTYYADSVKGRFTISRDNSKNTLYLQMNSLRDEDTAVYYCARSPAHYYGGMDVWGQGTTVTVSSASGGGGSGGRASGGGGSDIVLTQSPGTLSLSPGERATLSCRASQSISSSFLAWYQQKPGQAPRLLIYGASRRATGIPDRFSGSGSGTDFTLTISRLEPEDSAVYYCQQYHSSPSWTFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1426 - protein, 488 aa, Artificial Sequence
  source: /note="Description of Artificial Sequence: Synthetic Chimeric Antigen Receptor sequence"
MALPVTALLLPLALLLHAARPQVQLVESGGGLVQPGRSLRLSCAASGFTFDDYAMHWVRQAPGKGLEWVSGISWNSGSIGYADSVKGRFTISRDNAKNSLYLQMNSLRAEDTALYYCSVHSFLAYWGQGTLVTVSSASGGGGSGGRASGGGGSDIVMTQTPLSLPVTPGEPASISCRSSQSLLHSNGYNYLDWYLQKPGQSPQLLIYLGSNRASGVPDRFSGSGSGTDFTLKISRVEAEDVGVYYCMQALQTPYTFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1427 - protein, 483 aa, Artificial Sequence; identical to SEQ ID NO: 1351
  source: /note="Description of Artificial Sequence: Synthetic Chimeric Antigen Receptor sequence"

SEQ ID NO: 1428 - protein, 485 aa, Artificial Sequence; identical to SEQ ID NO: 1355
  source: /note="Description of Artificial Sequence: Synthetic Chimeric Antigen Receptor sequence"

SEQ ID NO: 1429 - protein, 483 aa, Artificial Sequence
  source: /note="Description of Artificial Sequence: Synthetic Chimeric Antigen Receptor sequence"
MALPVTALLLPLALLLHAARPQVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARESGDGMDVWGQGTTVTVSSASGGGGSGGRASGGGGSDIQMTQSPSSLSASVGDRVTITCRASQSISSYLNWYQQKPGKAPKLLIYAASSLQSGVPSRFSGSGSGTDFTLTISSLQPEDFATYYCQQSYTLAFGQGTKVDIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1430 - protein, 490 aa, Artificial Sequence
  source: /note="Description of Artificial Sequence: Synthetic Chimeric Antigen Receptor sequence"
MALPVTALLLPLALLLHAARPQVQLVQSGGGLVKPGGSLRLSCAASGFTFSDYYMSWIRQAPGKGLEWVSYISSSGNTIYYADSVKGRFTISRDNAKNSLYLQMNSLRAEDTAVYYCARSTMVREDYWGQGTLVTVSSASGGGGSGGRASGGGGSDIVLTQSPLSLPVTLGQPASISCKSSESLVHNSGKTYLNWFHQRPGQSPRRLIYEVSNRDSGVPDRFTGSGSGTDFTLKISRVEAEDVGVYYCMQGTHWPGTFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1431 - protein, 487 aa, Artificial Sequence
  source: /note="Description of Artificial Sequence: Synthetic Chimeric Antigen Receptor sequence"
MALPVTALLLPLALLLHAARPEVQLLESGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSSASGGGGSGGRASGGGGSDIVMTQTPLSLSVTPGQPASISCKSSQSLLRNDGKTPLYWYLQKAGQPPQLLIYEVSNRFSGVPDRFSGSGSGTDFTLKISRVEAEDVGAYYCMQNIQFPSFGGGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1432 - protein, 483 aa, Artificial Sequence
  source: /note="Description of Artificial Sequence: Synthetic Chimeric Antigen Receptor sequence"
MALPVTALLLPLALLLHAARPQVQLVESGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSSASGGGGSGGRASGGGGSDIRLTQSPSPLSASVGDRVTITCQASEDINKFLNWYHQTPGKAPKLLIYDASTLQTGVPSRFSGSGSGTDFTLTINSLQPEDIGTYYCQQYESLPLTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1433 - protein, 484 aa, Artificial Sequence
  source: /note="Description of Artificial Sequence: Synthetic Chimeric Antigen Receptor sequence"
MALPVTALLLPLALLLHAARPEVQLVETGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSSASGGGGSGGRASGGGGSETTLTQSPATLSVSPGERATLSCRASQSVGSNLAWYQQKPGQGPRLLIYGASTRATGIPARFSGSGSGTEFTLTISSLQPEDFAVYYCQQYNDWLPVTFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1434 - protein, 485 aa, Artificial Sequence
  source: /note="Description of Artificial Sequence: Synthetic Chimeric Antigen Receptor sequence"
MALPVTALLLPLALLLHAARPEVQLVESGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSSASGGGGSGGRASGGGGSEIVLTQSPGTLSLSPGERATLSCRASQSIGSSSLAWYQQKPGQAPRLLMYGASSRASGIPDRFSGSGSGTDFTLTISRLEPEDFAVYYCQQYAGSPPFTFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1435 - protein, 487 aa, Artificial Sequence
  source: /note="Description of Artificial Sequence: Synthetic Chimeric Antigen Receptor sequence"
MALPVTALLLPLALLLHAARPQVQLQESGPGLVKPSETLSLTCTVSGGSISSSYYYWGWIRQPPGKGLEWIGSIYYSGSAYYNPSLKSRVTISVDTSKNQFSLRLSSVTAADTAVYYCARHWQEWPDAFDIWGQGTMVTVSSGGGGSGGGGSGGGGSETTLTQSPAFMSATPGDKVIISCKASQDIDDAMNWYQQKPGEAPLFIIQSATSPVPGIPPRFSGSGFGTDFSLTINNIESEDAAYYFCLQHDNFPLTFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1436 - protein, 489 aa, Artificial Sequence
  source: /note="Description of Artificial Sequence: Synthetic Chimeric Antigen Receptor sequence"
MALPVTALLLPLALLLHAARPQVNLRESGPALVKPTQTLTLTCTFSGFSLRTSGMCVSWIRQPPGKALEWLARIDWDEDKFYSTSLKTRLTISKDTSDNQVVLRMTNMDPADTATYYCARSGAGGTSATAFDIWGPGTMVTVSSGGGGSGGGGSGGGGSDIQMTQSPSSLSASVGDRVTITCRASQDIYNNLAWFQLKPGSAPRSLMYAANKSQSGVPSRFSGSASGTDFTLTISSLQPEDFATYYCQHYYRFPYSFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1437 - protein, 490 aa, Artificial Sequence
  source: /note="Description of Artificial Sequence: Synthetic Chimeric Antigen Receptor sequence"
MALPVTALLLPLALLLHAARPEVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCAKTIAAVYAFDIWGQGTTVTVSSGGGGSGGGGSGGGGSEIVLTQSPLSLPVTPEEPASISCRSSQSLLHSNGYNYLDWYLQKPGQSPQLLIYLGSNRASGVPDRFSGSGSGTDFTLKISRVEAEDVGVYYCMQALQTPYTFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1438 - protein, 484 aa, Artificial Sequence
  source: /note="Description of Artificial Sequence: Synthetic Chimeric Antigen Receptor sequence"
MALPVTALLLPLALLLHAARPEVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDLRGAFDIWGQGTMVTVSSGGGGSGGGGSGGGGSSYVLTQSPSVSAAPGYTATISCGGNNIGTKSVHWYQQKPGQAPLLVIRDDSVRPSKIPGRFSGSNSGNMATLTISGVQAGDEADFYCQVWDSDSEHVVFGGGTKLTVLTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1439 - protein, 485 aa, Artificial Sequence; identical to SEQ ID NO: 1356
  source: /note="Description of Artificial Sequence: Synthetic Chimeric Antigen Receptor sequence"

SEQ ID NO: 1440 - protein, 489 aa, Artificial Sequence
  source: /note="Description of Artificial Sequence: Synthetic Chimeric Antigen Receptor sequence"
MALPVTALLLPLALLLHAARPQVQLQESGPGLVKPSQTLSLTCTVSGGSISSGGYYWSWIRQHPGKGLEWIGYIYYSGSTYYNPSLKSRVTISVDTSKNQFSLKLSSVTAADTAVYYCARAGIAARLRGAFDIWGQGTMVTVSSGGGGSGGGGSGGGGSDIVMTQSPSSVSASVGDRVIITCRASQGIRNWLAWYQQKPGKAPNLLIYAASNLQSGVPSRFSGSGSGADFTLTISSLQPEDVATYYCQKYNSAPFTFGPGTKVDIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1441 - protein, 497 aa, Artificial Sequence
  source: /note="Description of Artificial Sequence: Synthetic Chimeric Antigen Receptor sequence"
MALPVTALLLPLALLLHAARPQVQLVQSGAEVKKPGSSVKVSCKASGGTFSSYAISWVRQAPGQGLEWMGGIIPIFGTANYAQKFQGRVTITADESTSTAYMELSSLRSEDTAVYYCARRGGYQLLRWDVGLLRSAFDIWGQGTMVTVSSGGGGSGGGGSGGGGSSYVLTQPPSVSVAPGQTARITCGGNNIGSKSVHWYQQKPGQAPVLVLYGKNNRPSGVPDRFSGSRSGTTASLTITGAQAEDEADYYCSSRDSSGDHLRVFGTGTKVTVLTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1442 - protein, 492 aa, Artificial Sequence
  source: /note="Description of Artificial Sequence: Synthetic Chimeric Antigen Receptor sequence"
MALPVTALLLPLALLLHAARPEVQLQQSGPGLVKPSQTLSLTCAISGDSVSSNSAAWNWIRQSPSRGLEWLGRTYYRSKWYSFYAISLKSRIIINPDTSKNQFSLQLKSVTPEDTAVYYCARSSPEGLFLYWFDPWGQGTLVTVSSGGDGSGGGGSGGGGSSSELTQDPAVSVALGQTIRITCQGDSLGNYYATWYQQKPGQAPVLVIYGTNNRPSGIPDRFSASSSGNTASLTITGAQAEDEADYYCNSRDSSGHHLLFGTGTKVTVLTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1443 - protein, 483 aa, Artificial Sequence
  source: /note="Description of Artificial Sequence: Synthetic Chimeric Antigen Receptor sequence"
MALPVTALLLPLALLLHAARPEVQLVETGGGLVQPGRSLRLSCAASGFTFDDYAMHWVRQAPGKGLEWVSGISWNSGSIGYADSVKGRFTISRDNAKNSLYLQMNSLRDEDTAVYYCARVGKAVPDVWGQGTTVTVSSGGGGSGGGGSGGGGSDIVMTQTPSSLSASVGDRVTITCRASQSISSYLNWYQQKPGKAPKLLIYAASSLQSGVPSRFSGSGSGTDFTLTISSLQPEDFATYYCQQSYSTPYSFGQGTRLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1444 - protein, 488 aa, Artificial Sequence
  source: /note="Description of Artificial Sequence: Synthetic Chimeric Antigen Receptor sequence"
MALPVTALLLPLALLLHAARPEVQLLETGGGLVQPGGSLRLSCAASGFSFSSYAMSWVRQAPGKGLEWVSAISGSGGSTYYADSVKGRFTISRDNSKNTLYLQMNSLRAEDTAVYYCAKALVGATGAFDIWGQGTLVTVSSGGGGSGGGGSGGGGSEIVLTQSPGTLSLSPGERATLSCRASQSLSSNFLAWYQQKPGQAPGLLIYGASNWATGTPDRFSGSGSGTDFTLTITRLEPEDFAVYYCQYYGTSPMYTFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1445 - protein, 492 aa, Artificial Sequence; identical to SEQ ID NO: 1374
  source: /note="Description of Artificial Sequence: Synthetic Chimeric Antigen Receptor sequence"

SEQ ID NO: 1446 - protein, 490 aa, Artificial Sequence
  source: /note="Description of Artificial Sequence: Synthetic Chimeric Antigen Receptor sequence"
MALPVTALLLPLALLLHAARPEVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCAKVEGSGSLDYWGQGTLVTVSSGGGGSGGGGSGGGGSEIVMTQSPGTLSLSPGERATLSCRASQSVSSAYLAWYQQKPGQPPRLLISGASTRATGIPDRFGGSGSGTDFTLTISRLEPEDFAVYYCQHYGSSFNGSSLFTFGQGTRLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1447 - protein, 485 aa, Artificial Sequence; identical to SEQ ID NO: 1354
  source: /note="Description of Artificial Sequence: Synthetic Chimeric Antigen Receptor sequence"

SEQ ID NO: 1448 - protein, 490 aa, Artificial Sequence
  source: /note="Description of Artificial Sequence: Synthetic Chimeric Antigen Receptor sequence"
MALPVTALLLPLALLLHAARPEVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCAKMGWSSGYLGAFDIWGQGTTVTVSSGGGGSGGGGSGGGGSEIVLTQSPGTLSLSPGERATLSCRASQSVASSFLAWYQQKPGQAPRLLIYGASGRATGIPDRFSGSGSGTDFTLTISRLEPEDFAVYYCQHYGGSPRLTFGGGTKVDIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1449 - protein, 492 aa, Artificial Sequence
  source: /note="Description of Artificial Sequence: Synthetic Chimeric Antigen Receptor sequence"
MALPVTALLLPLALLLHAARPQVQLVESGGGLVQPGGSLRLSCAASGFTFSSYAMSWVRQAPGKGLEWVSAISGSGGSTYYADSVKGRFTISRDNAKNSLYLQMNSLRAEDTAIYYCARATYKRELRYYYGMDVWGQGTMVTVSSGGGGSGGGGSGGGGSEIVMTQSPGTVSLSPGERATLSCRASQSVSSSFLAWYQQKPGQAPRLLIYGASSRATGIPDRFSGSGSGTDFTLTISRLEPEDSAVYYCQQYHSSPSWTFGQGTRLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1450 - protein, 490 aa, Artificial Sequence
  source: /note="Description of Artificial Sequence: Synthetic Chimeric Antigen Receptor sequence"
MALPVTALLLPLALLLHAARPEVQLVESGGGLVQPGRSLRLSCTASGFTFDDYAMHWVRQRPGKGLEWVASINWKGNSLAYGDSVKGRFAISRDNAKNTVFLQMNSLRTEDTAVYYCASHQGVAYYNYAMDVWGRGTLVTVSSGGGGSGGGGSGGGGSEIVLTQSPGTLSLSPGERATLSCRATQSIGSSFLAWYQQRPGQAPRLLIYGASQRATGIPDRFSGRGSGTDFTLTISRVEPEDSAVYYCQHYESSPSWTFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1451 - protein, 486 aa, Artificial Sequence
  source: /note="Description of Artificial Sequence: Synthetic Chimeric Antigen Receptor sequence"
MALPVTALLLPLALLLHAARPEVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKIPQTGTFDYWGQGTLVTVSSGGGGSGGGGSGGGGSEIVLTQSPGTLSLSPGERATLSCRASQSVSSSYLAWYQQRPGQAPRLLIYGASSRATGIPDRFSGSGSGTDFTLTISRLEPEDFAVYYCQHYGSSPSWTFGQGTRLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1452 - protein, 488 aa, Artificial Sequence
  source: /note="Description of Artificial Sequence: Synthetic Chimeric Antigen Receptor sequence"
MALPVTALLLPLALLLHAARPEVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCVLWFGEGFDPWGQGTLVTVSSGGGGSGGGGSGGGGSDIVLTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPLTFGGGTKVDIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1453 - protein, 485 aa, Artificial Sequence; identical to SEQ ID NO: 1353
  source: /note="Description of Artificial Sequence: Synthetic Chimeric Antigen Receptor sequence"

SEQ ID NO: 1454 - protein, 495 aa, Artificial Sequence
  source: /note="Description of Artificial Sequence: Synthetic Chimeric Antigen Receptor sequence"
MALPVTALLLPLALLLHAARPQVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCAKVGYDSSGYYRDYYGMDVWGQGTTVTVSSGGGGSGGGGSGGGGSEIVLTQSPGTLSLSPGERATLSCRASQSVSSSYLAWYQQKPGQAPRLLIYGTSSRATGISDRFSGSGSGTDFTLTISRLEPEDFAVYYCQHYGNSPPKFTFGPGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1455 - protein, 449 aa, Artificial Sequence
  source: /note="Description of Artificial Sequence: Synthetic Chimeric Antigen Receptor sequence"
EVKLVESGGGLVQPGGSLSLSCAASGFTFTDYYMSWVRQPPGKALEWLALIRSKADGYTTEYSASVKGRFTLSRDDSQSILYLQMNALRPEDSATYYCARDAAYYSYYSPEGAMDYWGQGTSVTVSSGGGGSGGGGSGGGGSMADYKDIVMTQSHKFMSTSVGDRVNITCKASQNVDSAVAWYQQKPGQSPKALIYSASYRYSGVPDRFTGRGSGTDFTLTISSVQAEDLAVYYCQQYYSTPWTFGGGTKLEIKRGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1456 - protein, 424 aa, Artificial Sequence
  source: /note="Description of Artificial Sequence: Synthetic Chimeric Antigen Receptor sequence"
METDTLLLWVLLLWVPGSTGSVLHLVPINATSKDDSDVTEVMWQPALRRGRGLQAQGYGVRIQDAGVYLLYSQVLFQDVTFTMGQVVSREGQGRQETLFRCIRSMPSHPDRAYNSCYSAGVFHLHQGDILSVIIPRARAKLNLSPHGTFLGFVKLSGGGSDPTTTPAPRPPTPAPTIASQPLSLRPEACRPAAGGAVHTRGLDFACDIFWVLVVVGGVLACYSLLVTVAFIIFWVRSKRSRLLHSDYMNMTPRRPGPTRKHYQPYAPPRDFAAYRSRDQRLPPDAHKPPGGGSFRTPIQEEQADAHSTLAKIRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1457 - protein, 436 aa, Artificial Sequence
  source: /note="Description of Artificial Sequence: Synthetic Chimeric Antigen Receptor sequence"
EVQLQQSGPELVKPGASVKISCKASGYTFTDYNMHWVKQSHGKSLEWIGYIYPYNGGTGYNQKFKSKATLTVDNSSSTAYMDVRSLTSEDSAVYYCARGRPAMDYWGQGTSVTVSSGGGGSGGGGSGGGGSDIVLTQSPASLAVSLGQRATISCRASESVDNYGISFMNWFQQKPGQPPKLLIYAASNQGSGVPARFSGSGSGTDFSLNIHPMEEDDTAMYFCQQSKEVPWTFGGGTKLEIKGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1458 - protein, 434 aa, Artificial Sequence
  source: /note="Description of Artificial Sequence: Synthetic Chimeric Antigen Receptor sequence"
QVQLQQSGPELVRPGTFVKISCKASGYTFTNYDINWVNQRPGQGLEWIGWIYPGDGSTKYNEKFKAKATLTADKSSSTAYLQLNNLTSENSAVYFCASGYEDAMDYWGQGTSVTVSSGGGGSGGGGSGGGGSDIKMTQSPSSMYASLGERVIINCKASQDINSYLSWFQQKPGKSPKTLIYRANRLVDGVPSRFSGSGSGQDYSLTISSLEYEDMGIYYCLQYDEFPLTFGAGTKLELKRGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1459 - protein, 437 aa, Artificial Sequence
  source: /note="Description of Artificial Sequence: Synthetic Chimeric Antigen Receptor sequence"
QVQLQQSGPELVRPGTFVKISCKASGYTFTNYDINWVNQRPGQGLEWIGWIYPGDGSTKYNEKFKAKATLTADKSSSTAYLQLNNLTSENSAVYFCASGYEDAMDYWGQGTSVTVSSGGGGSGGGGSGGGGSDIKMTQSPSSMYASLGERVIINCKASQDINSYLSWFQQKPGKSPKTLIYRANRLVDGVPSRFSGSGSGQDYSLTISSLEYEDMGIYYCLQYDEFPLTFGAGTKLELKRGLAVSTISSFFPPGYQIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1460 - protein, 439 aa, Artificial Sequence
  source: /note="Description of Artificial Sequence: Synthetic Chimeric Antigen Receptor sequence"
EVQLQQSGPELVKPGASVKISCKASGYTFTDYNMHWVKQSHGKSLEWIGYIYPYNGGTGYNQKFKSKATLTVDNSSSTAYMDVRSLTSEDSAVYYCARGRPAMDYWGQGTSVTVSSGGGGSGGGGSGGGGSDIVLTQSPASLAVSLGQRATISCRASESVDNYGISFMNWFQQKPGQPPKLLIYAASNQGSGVPARFSGSGSGTDFSLNIHPMEEDDTAMYFCQQSKEVPWTFGGGTKLEIKGLAVSTISSFFPPGYQIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1461 - protein, 440 aa, Artificial Sequence
  source: /note="Description of Artificial Sequence: Synthetic Chimeric Antigen Receptor sequence"
QVQLQQPGAEVVKPGASVKMSCKASGYTFTSYYIHWIKQTPGQGLEWVGVIYPGNDDISYNQKFKGKATLTADKSSTTAYMQLSSLTSEDSAVYYCAREVRLRYFDVWGAGTTVTVSSGGGGSGGGGSGGGGSNIMLTQSPSSLAVSAGEKVTMSCKSSQSVFFSSSQKNYLAWYQQIPGQSPKLLIYWASTRESGVPDRFTGSGSGTDFTLTISSVQSEDLAIYYCHQYLSSRTFGGGTKLEIKRGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1462 - protein, 443 aa, Artificial Sequence
  source: /note="Description of Artificial Sequence: Synthetic Chimeric Antigen Receptor sequence"
QVQLQQPGAEVVKPGASVKMSCKASGYTFTSYYIHWIKQTPGQGLEWVGVIYPGNDDISYNQKFKGKATLTADKSSTTAYMQLSSLTSEDSAVYYCAREVRLRYFDVWGAGTTVTVSSGGGGSGGGGSGGGGSNIMLTQSPSSLAVSAGEKVTMSCKSSQSVFFSSSQKNYLAWYQQIPGQSPKLLIYWASTRESGVPDRFTGSGSGTDFTLTISSVQSEDLAIYYCHQYLSSRTFGGGTKLEIKRGLAVSTISSFFPPGYQIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1463 - protein, 444 aa, Artificial Sequence
  source: /note="Description of Artificial Sequence: Synthetic Chimeric Antigen Receptor sequence"
EVKLQESGPELVKPGASVKMSCKASGYKFTDYVVHWLKQKPGQGLEWIGYINPYNDGTKYNEKFKGKATLTSDKSSSTAYMEVSSLTSEDSAVYYCARDYRYEVYGMDYWGQGTSVTVSSGGGGSGGGGSGGGGSDIVLTQSPTIMSASPGERVTMTCTASSSVNYIHWYQQKSGDSPLRWIFDTSKVASGVPARFSGSGSGTSYSLTISTMEAEDAATYYCQQWRSYPLTFGDGTRLELKRADAAPTVSGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1464 - protein, 447 aa, Artificial Sequence
  source: /note="Description of Artificial Sequence: Synthetic Chimeric Antigen Receptor sequence"
EVKLQESGPELVKPGASVKMSCKASGYKFTDYVVHWLKQKPGQGLEWIGYINPYNDGTKYNEKFKGKATLTSDKSSSTAYMEVSSLTSEDSAVYYCARDYRYEVYGMDYWGQGTSVTVSSGGGGSGGGGSGGGGSDIVLTQSPTIMSASPGERVTMTCTASSSVNYIHWYQQKSGDSPLRWIFDTSKVASGVPARFSGSGSGTSYSLTISTMEAEDAATYYCQQWRSYPLTFGDGTRLELKRADAAPTVSGLAVSTISSFFPPGYQIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1465 - protein, 463 aa, Artificial Sequence
  source: /note="Description of Artificial Sequence: Synthetic Chimeric Antigen Receptor sequence"
QVQLQQSGPELVRPGTFVKISCKASGYTFTNYDINWVNQRPGQGLEWIGWIYPGDGSTKYNEKFKAKATLTADKSSSTAYLQLNNLTSENSAVYFCASGYEDAMDYWGQGTSVTVSSGGGGSGGGGSGGGGSDIKMTQSPSSMYASLGERVIINCKASQDINSYLSWFQQKPGKSPKTLIYRANRLVDGVPSRFSGSGSGQDYSLTISSLEYEDMGIYYCLQYDEFPLTFGAGTKLELKRTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1466 - protein, 465 aa, Artificial Sequence
  source: /note="Description of Artificial Sequence: Synthetic Chimeric Antigen Receptor sequence"
EVQLQQSGPELVKPGASVKISCKASGYTFTDYNMHWVKQSHGKSLEWIGYIYPYNGGTGYNQKFKSKATLTVDNSSSTAYMDVRSLTSEDSAVYYCARGRPAMDYWGQGTSVTVSSGGGGSGGGGSGGGGSDIVLTQSPASLAVSLGQRATISCRASESVDNYGISFMNWFQQKPGQPPKLLIYAASNQGSGVPARFSGSGSGTDFSLNIHPMEEDDTAMYFCQQSKEVPWTFGGGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1467 - protein, 466 aa, Artificial Sequence
  source: /note="Description of Artificial Sequence: Synthetic Chimeric Antigen Receptor sequence"
QVQLQQSGPELVRPGTFVKISCKASGYTFTNYDINWVNQRPGQGLEWIGWIYPGDGSTKYNEKFKAKATLTADKSSSTAYLQLNNLTSENSAVYFCASGYEDAMDYWGQGTSVTVSSGGGGSGGGGSGGGGSDIKMTQSPSSMYASLGERVIINCKASQDINSYLSWFQQKPGKSPKTLIYRANRLVDGVPSRFSGSGSGQDYSLTISSLEYEDMGIYYCLQYDEFPLTFGAGTKLELKRTTTPAPRPPTPAPTIASQPLSLRPEACRPAAGGAVHTRGLDFACDIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1468 - protein, 468 aa, Artificial Sequence
  source: /note="Description of Artificial Sequence: Synthetic Chimeric Antigen Receptor sequence"
EVQLQQSGPELVKPGASVKISCKASGYTFTDYNMHWVKQSHGKSLEWIGYIYPYNGGTGYNQKFKSKATLTVDNSSSTAYMDVRSLTSEDSAVYYCARGRPAMDYWGQGTSVTVSSGGGGSGGGGSGGGGSDIVLTQSPASLAVSLGQRATISCRASESVDNYGISFMNWFQQKPGQPPKLLIYAASNQGSGVPARFSGSGSGTDFSLNIHPMEEDDTAMYFCQQSKEVPWTFGGGTKLEIKTTTPAPRPPTPAPTIASQPLSLRPEACRPAAGGAVHTRGLDFACDIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1469 - protein, 469 aa, Artificial Sequence
  source: /note="Description of Artificial Sequence: Synthetic Chimeric Antigen Receptor sequence"
QVQLQQPGAEVVKPGASVKMSCKASGYTFTSYYIHWIKQTPGQGLEWVGVIYPGNDDISYNQKFKGKATLTADKSSTTAYMQLSSLTSEDSAVYYCAREVRLRYFDVWGAGTTVTVSSGGGGSGGGGSGGGGSNIMLTQSPSSLAVSAGEKVTMSCKSSQSVFFSSSQKNYLAWYQQIPGQSPKLLIYWASTRESGVPDRFTGSGSGTDFTLTISSVQSEDLAIYYCHQYLSSRTFGGGTKLEIKRTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1470 - protein, 472 aa, Artificial Sequence
  source: /note="Description of Artificial Sequence: Synthetic Chimeric Antigen Receptor sequence"
QVQLQQPGAEVVKPGASVKMSCKASGYTFTSYYIHWIKQTPGQGLEWVGVIYPGNDDISYNQKFKGKATLTADKSSTTAYMQLSSLTSEDSAVYYCAREVRLRYFDVWGAGTTVTVSSGGGGSGGGGSGGGGSNIMLTQSPSSLAVSAGEKVTMSCKSSQSVFFSSSQKNYLAWYQQIPGQSPKLLIYWASTRESGVPDRFTGSGSGTDFTLTISSVQSEDLAIYYCHQYLSSRTFGGGTKLEIKRTTTPAPRPPTPAPTIASQPLSLRPEACRPAAGGAVHTRGLDFACDIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1471 - protein, 473 aa, Artificial Sequence
  source: /note="Description of Artificial Sequence: Synthetic Chimeric Antigen Receptor sequence"
EVKLQESGPELVKPGASVKMSCKASGYKFTDYVVHWLKQKPGQGLEWIGYINPYNDGTKYNEKFKGKATLTSDKSSSTAYMEVSSLTSEDSAVYYCARDYRYEVYGMDYWGQGTSVTVSSGGGGSGGGGSGGGGSDIVLTQSPTIMSASPGERVTMTCTASSSVNYIHWYQQKSGDSPLRWIFDTSKVASGVPARFSGSGSGTSYSLTISTMEAEDAATYYCQQWRSYPLTFGDGTRLELKRADAAPTVSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1472 - protein, 476 aa, Artificial Sequence
  source: /note="Description of Artificial Sequence: Synthetic Chimeric Antigen Receptor sequence"
EVKLQESGPELVKPGASVKMSCKASGYKFTDYVVHWLKQKPGQGLEWIGYINPYNDGTKYNEKFKGKATLTSDKSSSTAYMEVSSLTSEDSAVYYCARDYRYEVYGMDYWGQGTSVTVSSGGGGSGGGGSGGGGSDIVLTQSPTIMSASPGERVTMTCTASSSVNYIHWYQQKSGDSPLRWIFDTSKVASGVPARFSGSGSGTSYSLTISTMEAEDAATYYCQQWRSYPLTFGDGTRLELKRADAAPTVSTTTPAPRPPTPAPTIASQPLSLRPEACRPAAGGAVHTRGLDFACDIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1473 - protein, 649 aa, Artificial Sequence
  source: /note="Description of Artificial Sequence: Synthetic Chimeric Antigen Receptor sequence"
QVQLQQSGPELVRPGTFVKISCKASGYTFTNYDINWVNQRPGQGLEWIGWIYPGDGSTKYNEKFKAKATLTADKSSSTAYLQLNNLTSENSAVYFCASGYEDAMDYWGQGTSVTVSSGGGGSGGGGSGGGGSDIKMTQSPSSMYASLGERVIINCKASQDINSYLSWFQQKPGKSPKTLIYRANRLVDGVPSRFSGSGSGQDYSLTISSLEYEDMGIYYCLQYDEFPLTFGAGTKLELKREPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1474 - protein, 651 aa, Artificial Sequence
  source: /note="Description of Artificial Sequence: Synthetic Chimeric Antigen Receptor sequence"
EVQLQQSGPELVKPGASVKISCKASGYTFTDYNMHWVKQSHGKSLEWIGYIYPYNGGTGYNQKFKSKATLTVDNSSSTAYMDVRSLTSEDSAVYYCARGRPAMDYWGQGTSVTVSSGGGGSGGGGSGGGGSDIVLTQSPASLAVSLGQRATISCRASESVDNYGISFMNWFQQKPGQPPKLLIYAASNQGSGVPARFSGSGSGTDFSLNIHPMEEDDTAMYFCQQSKEVPWTFGGGTKLEIKEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1475 - protein, 654 aa, Artificial Sequence
  source: /note="Description of Artificial Sequence: Synthetic Chimeric Antigen Receptor sequence"
EVQLQQSGPELVKPGASVKISCKASGYTFTDYNMHWVKQSHGKSLEWIGYIYPYNGGTGYNQKFKSKATLTVDNSSSTAYMDVRSLTSEDSAVYYCARGRPAMDYWGQGTSVTVSSGGGGSGGGGSGGGGSDIVLTQSPASLAVSLGQRATISCRASESVDNYGISFMNWFQQKPGQPPKLLIYAASNQGSGVPARFSGSGSGTDFSLNIHPMEEDDTAMYFCQQSKEVPWTFGGGTKLEIKEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1476 - protein, 655 aa, Artificial Sequence
  source: /note="Description of Artificial Sequence: Synthetic Chimeric Antigen Receptor sequence"
QVQLQQPGAEVVKPGASVKMSCKASGYTFTSYYIHWIKQTPGQGLEWVGVIYPGNDDISYNQKFKGKATLTADKSSTTAYMQLSSLTSEDSAVYYCAREVRLRYFDVWGAGTTVTVSSGGGGSGGGGSGGGGSNIMLTQSPSSLAVSAGEKVTMSCKSSQSVFFSSSQKNYLAWYQQIPGQSPKLLIYWASTRESGVPDRFTGSGSGTDFTLTISSVQSEDLAIYYCHQYLSSRTFGGGTKLEIKREPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1477 - protein, 658 aa, Artificial Sequence
  source: /note="Description of Artificial Sequence: Synthetic Chimeric Antigen Receptor sequence"
QVQLQQPGAEVVKPGASVKMSCKASGYTFTSYYIHWIKQTPGQGLEWVGVIYPGNDDISYNQKFKGKATLTADKSSTTAYMQLSSLTSEDSAVYYCAREVRLRYFDVWGAGTTVTVSSGGGGSGGGGSGGGGSNIMLTQSPSSLAVSAGEKVTMSCKSSQSVFFSSSQKNYLAWYQQIPGQSPKLLIYWASTRESGVPDRFTGSGSGTDFTLTISSVQSEDLAIYYCHQYLSSRTFGGGTKLEIKREPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1478 - protein, 659 aa, Artificial Sequence
  source: /note="Description of Artificial Sequence: Synthetic Chimeric Antigen Receptor sequence"
EVKLQESGPELVKPGASVKMSCKASGYKFTDYVVHWLKQKPGQGLEWIGYINPYNDGTKYNEKFKGKATLTSDKSSSTAYMEVSSLTSEDSAVYYCARDYRYEVYGMDYWGQGTSVTVSSGGGGSGGGGSGGGGSDIVLTQSPTIMSASPGERVTMTCTASSSVNYIHWYQQKSGDSPLRWIFDTSKVASGVPARFSGSGSGTSYSLTISTMEAEDAATYYCQQWRSYPLTFGDGTRLELKRADAAPTVSEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1479 - protein, 662 aa, Artificial Sequence
  source: /note="Description of Artificial Sequence: Synthetic Chimeric Antigen Receptor sequence"
EVKLQESGPELVKPGASVKMSCKASGYKFTDYVVHWLKQKPGQGLEWIGYINPYNDGTKYNEKFKGKATLTSDKSSSTAYMEVSSLTSEDSAVYYCARDYRYEVYGMDYWGQGTSVTVSSGGGGSGGGGSGGGGSDIVLTQSPTIMSASPGERVTMTCTASSSVNYIHWYQQKSGDSPLRWIFDTSKVASGVPARFSGSGSGTSYSLTISTMEAEDAATYYCQQWRSYPLTFGDGTRLELKRADAAPTVSEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1480 - protein, 378 aa, Artificial Sequence
  source: /note="Description of Artificial Sequence: Synthetic Chimeric Antigen Receptor sequence"
MVLLWLTLLLIALPCLLQTKEDPNPPITNLRMKAKAQQLTWDLNRNVTDIECVKDADYSMPAVNNSYCQFGAISLCEVTNYTVRVANPPFSTWILFPENSGKPWAGAENLTCWIHDVDFLSCSWAVGPGAPADVQYDLYLNVANRRQQYECLHYKTDAQGTRIGCRFDDISRLSSGSQSSHILVRGRSAAFGIPCTDKFVVFSQIEILTPPNMTAKCNKTHSFMHWKMRSHFNRKFRYELQIQKRMQPVITEQVRDRTSFQLLNPGTYTVQIRARERVYEFLSAWSTPQRFECDQEEGANTRAWRTSLLIALGTLLALVCVFVICRRYLVMQRLFPRIPHMKDPIGDSFQNDKLVVWEAGKAGLEECLVTEVQVVQKT

SEQ ID NO: 1481 - protein, 383 aa, Artificial Sequence
  source: /note="Description of Artificial Sequence: Synthetic Chimeric Antigen Receptor sequence"
MALPVTALLLPLALLLHAARPGSGSGAQAAQVQLVQSGAEVKKPGASVKVSCKASGYSFPDYYINWVRQAPGQGLEWMGWIYFASGNSEYNQKFTGRVTMTRDTSSSTAYMELSSLRSEDTAVYFCASLYDYDWYFDVWGQGTMVTVSSGGGGSGGGGSGGGGSDIVMTQTPLSLSVTPGEPASISCKSSQSLVHSNGNTYLHWYLQKPGQSPQLLIYKVSNRFSGVPDRFSGSGSGADFTLKISRVEAEDVGVYYCAETSHVPWTFGQGTKLEIKRSDPASGAGSGSGSAVKEGPPSEHSGISRNAIIFLVLGILVFLILLGIGIYFYWSKCSREVLWHCHLCPSSTEHASASANGHVSYSAVSRENSSSQDPQTEGTRSHG

SEQ ID NO: 1482 - protein, 391 aa, Artificial Sequence
  source: /note="Description of Artificial Sequence: Synthetic Chimeric Antigen Receptor sequence"
MALPVTALLLPLALLLHAARPGSGSGAQAAQVQLVQSGAEVKKPGASVKVSCKASGYSFPDYYINWVRQAPGQGLEWMGWIYFASGNSEYNQKFTGRVTMTRDTSSSTAYMELSSLRSEDTAVYFCASLYDYDWYFDVWGQGTMVTVSSGGGGSGGGGSGGGGSDIVMTQTPLSLSVTPGEPASISCKSSQSLVHSNGNTYLHWYLQKPGQSPQLLIYKVSNRFSGVPDRFSGSGSGADFTLKISRVEAEDVGVYYCAETSHVPWTFGQGTKLEIKRSDPASGAGSGSGSAVQAPSSSPMGIIVAVVTGIAVAAIVAAVVALIYCRKKRISALPGYPECREMGETLPEKPANPTNPDEADKVGAENTITYSLLMHPDALEEPDDQNRISHG

SEQ ID NO: 1483 - protein, 409 aa, Artificial Sequence
  source: /note="Description of Artificial Sequence: Synthetic Chimeric Antigen Receptor sequence"
MALPVTALLLPLALLLHAARPGSGSGAQAAQVQLVQSGAEVKKPGASVKVSCKASGYSFPDYYINWVRQAPGQGLEWMGWIYFASGNSEYNQKFTGRVTMTRDTSSSTAYMELSSLRSEDTAVYFCASLYDYDWYFDVWGQGTMVTVSSGGGGSGGGGSGGGGSDIVMTQTPLSLSVTPGEPASISCKSSQSLVHSNGNTYLHWYLQKPGQSPQLLIYKVSNRFSGVPDRFSGSGSGADFTLKISRVEAEDVGVYYCAETSHVPWTFGQGTKLEIKRSDPASGAGSGSGSASFRALPHAWSDPSDPLPVSVTGNSRYLHALIGTSVVIIPFAILLFFLLHRWCANKKNAVVMDQEPAGNRTVNREDSDEQDPQEVTYAQLNHCVFTQRKITRPSQRPKTPPTDTSVSHG

SEQ ID NO: 1484 - protein, 414 aa, Artificial Sequence
  source: /note="Description of Artificial Sequence: Synthetic Chimeric Antigen Receptor sequence"
MALPVTALLLPLALLLHAARPGSGSGAQAAQVQLVQSGAEVKKPGASVKVSCKASGYSFPDYYINWVRQAPGQGLEWMGWIYFASGNSEYNQKFTGRVTMTRDTSSSTAYMELSSLRSEDTAVYFCASLYDYDWYFDVWGQGTMVTVSSGGGGSGGGGSGGGGSDIVMTQTPLSLSVTPGEPASISCKSSQSLVHSNGNTYLHWYLQKPGQSPQLLIYKVSNRFSGVPDRFSGSGSGADFTLKISRVEAEDVGVYYCAETSHVPWTFGQGTKLEIKRSDPASGAGSGSGSALFVHWKPEGRAGGVLGAVWGASITTLVFLCVCFIFRVKTRRKKAAQPVQNTDDVNPVMVSGSRGHQHQFQTGIVSDHPAEAGPISEDEQELHYAVLHFHKVQPQEPKVTDTEYSEIKIHKSHG

SEQ ID NO: 1485 - protein, 415 aa, Artificial Sequence
  source: /note="Description of Artificial Sequence: Synthetic Chimeric Antigen Receptor sequence"
MALPVTALLLPLALLLHAARPGSGSGAQAAQVQLVQSGAEVKKPGASVKVSCKASGYSFPDYYINWVRQAPGQGLEWMGWIYFASGNSEYNQKFTGRVTMTRDTSSSTAYMELSSLRSEDTAVYFCASLYDYDWYFDVWGQGTMVTVSSGGGGSGGGGSGGGGSDIVMTQTPLSLSVTPGEPASISCKSSQSLVHSNGNTYLHWYLQKPGQSPQLLIYKVSNRFSGVPDRFSGSGSGADFTLKISRVEAEDVGVYYCAETSHVPWTFGQGTKLEIKRSDPASGAGSGSGSAGPDGYRRDLMTAGVLWGLFGVLGFTGVALLLYALFHKISGESSATNEPRGASRPNPQEFTYSSPTPDMEELQPVYVNVGSVDVDVVYSQVWSMQQPESSANIRTLLENKDSQVIYSSVKKSSHG

SEQ ID NO: 1486 - protein, 417 aa, Artificial Sequence
  source: /note="Description of Artificial Sequence: Synthetic Chimeric Antigen Receptor sequence"
MALPVTALLLPLALLLHAARPGSGSGAQAAQVQLVQSGAEVKKPGASVKVSCKASGYSFPDYYINWVRQAPGQGLEWMGWIYFASGNSEYNQKFTGRVTMTRDTSSSTAYMELSSLRSEDTAVYFCASLYDYDWYFDVWGQGTMVTVSSGGGGSGGGGSGGGGSDIVMTQTPLSLSVTPGEPASISCKSSQSLVHSNGNTYLHWYLQKPGQSPQLLIYKVSNRFSGVPDRFSGSGSGADFTLKISRVEAEDVGVYYCAETSHVPWTFGQGTKLEIKRSDPASGAGSGSGSAPGHIRLYVVEKENLPVFPVWVVVGIVTAVVLGLTLLISMILAVLYRRKNSKRDYTGCSTSESLSPVKQAPRKSPSDTEGLVKSLPSGSHQGPVIYAQLDHSGGHHSDKINKSESVVYADIRKNSHG

SEQ ID NO: 1487 - protein, 421 aa, Artificial Sequence
  source: /note="Description of Artificial Sequence: Synthetic Chimeric Antigen Receptor sequence"
MALPVTALLLPLALLLHAARPGSGSGAQAAQVQLVQSGAEVKKPGASVKVSCKASGYSFPDYYINWVRQAPGQGLEWMGWIYFASGNSEYNQKFTGRVTMTRDTSSSTAYMELSSLRSEDTAVYFCASLYDYDWYFDVWGQGTMVTVSSGGGGSGGGGSGGGGSDIVMTQTPLSLSVTPGEPASISCKSSQSLVHSNGNTYLHWYLQKPGQSPQLLIYKVSNRFSGVPDRFSGSGSGADFTLKISRVEAEDVGVYYCAETSHVPWTFGQGTKLEIKRSDPASGAGSGSGSALQSKATSGVTQGVVGGAGATALVFLSFCVIFVVVRSCRKKSARPAAGVGDTGIEDANAVRGSASQGPLTEPWAEDSPPDQPPPASARSSVGEGELQYASLSFQMVKPWDSRGQEATDTEYSEIKIHRSHG

SEQ ID NO: 1488 - protein, 424 aa, Artificial Sequence
  source: /note="Description of Artificial Sequence: Synthetic Chimeric Antigen Receptor sequence"
MALPVTALLLPLALLLHAARPGSGSGAQAAQVQLVQSGAEVKKPGASVKVSCKASGYSFPDYYINWVRQAPGQGLEWMGWIYFASGNSEYNQKFTGRVTMTRDTSSSTAYMELSSLRSEDTAVYFCASLYDYDWYFDVWGQGTMVTVSSGGGGSGGGGSGGGGSDIVMTQTPLSLSVTPGEPASISCKSSQSLVHSNGNTYLHWYLQKPGQSPQLLIYKVSNRFSGVPDRFSGSGSGADFTLKISRVEAEDVGVYYCAETSHVPWTFGQGTKLEIKRSDPASGAGSGSGSAMPSTGGDSCPFCLKLLLPGLLLLLVVIILILAFWVLPKYKTRKAMRNNVPRDRGDTAMEVGIYANILEKQAKEESVPEVGSRPCVSTAQDEAKHSQELQYATPVFQEVAPREQEACDSYKSGYVYSELNFSHG

SEQ ID NO: 1489 - protein, 425 aa, Artificial Sequence
  source: /note="Description of Artificial Sequence: Synthetic Chimeric Antigen Receptor sequence"
MALPVTALLLPLALLLHAARPGSGSGAQAAQVQLVQSGAEVKKPGASVKVSCKASGYSFPDYYINWVRQAPGQGLEWMGWIYFASGNSEYNQKFTGRVTMTRDTSSSTAYMELSSLRSEDTAVYFCASLYDYDWYFDVWGQGTMVTVSSGGGGSGGGGSGGGGSDIVMTQTPLSLSVTPGEPASISCKSSQSLVHSNGNTYLHWYLQKPGQSPQLLIYKVSNRFSGVPDRFSGSGSGADFTLKISRVEAEDVGVYYCAETSHVPWTFGQGTKLEIKRSDPASGAGSGSGSALQQEYTGKMRPVSGVLLGAVGGAGATALVFLSFCVIFIVVRSCRKKSARPAADVGDIGMKDANTIRGSASQGNLTESWADDNPRHHGLAAHSSGEEREIQYAPLSFHKGEPQDLSGQEATNNEYSEIKIPKSHG

SEQ ID NO: 1490 - protein, 427 aa, Artificial Sequence
  source: /note="Description of Artificial Sequence: Synthetic Chimeric Antigen Receptor sequence"
MALPVTALLLPLALLLHAARPGSGSGAQAAQVQLVQSGAEVKKPGASVKVSCKASGYSFPDYYINWVRQAPGQGLEWMGWIYFASGNSEYNQKFTGRVTMTRDTSSSTAYMELSSLRSEDTAVYFCASLYDYDWYFDVWGQGTMVTVSSGGGGSGGGGSGGGGSDIVMTQTPLSLSVTPGEPASISCKSSQSLVHSNGNTYLHWYLQKPGQSPQLLIYKVSNRFSGVPDRFSGSGSGADFTLKISRVEAEDVGVYYCAETSHVPWTFGQGTKLEIKRSDPASGAGSGSGSALQNEYTGKMRPISGVTLGAFGGAGATALVFLYFCIIFVVVRSCRKKSARPAVGVGDTGMEDANAVRGSASQGPLIESPADDSPPHHAPPALATPSPEEGEIQYASLSFHKARPQYPQEQEAIGYEYSEINIPKSHG

SEQ ID NO: 1491 - protein, 430 aa, Artificial Sequence
  source: /note="Description of Artificial Sequence: Synthetic Chimeric Antigen Receptor sequence"
MALPVTALLLPLALLLHAARPGSGSGAQAAQVQLVQSGAEVKKPGASVKVSCKASGYSFPDYYINWVRQAPGQGLEWMGWIYFASGNSEYNQKFTGRVTMTRDTSSSTAYMELSSLRSEDTAVYFCASLYDYDWYFDVWGQGTMVTVSSGGGGSGGGGSGGGGSDIVMTQTPLSLSVTPGEPASISCKSSQSLVHSNGNTYLHWYLQKPGQSPQLLIYKVSNRFSGVPDRFSGSGSGADFTLKISRVEAEDVGVYYCAETSHVPWTFGQGTKLEIKRSDPASGAGSGSGSALNVTYVPQNPTTGIFPGDGSGKQETRAGVVHGAIGGAGVTALLALCLCLIFFIVKTHRRKAARTAVGRNDTHPTTGSASPKHQKKSKLHGPTETSSCSGAAPTVEMDEELHYASLNFHGMNPSKDTSTEYSEVRTQSHG

SEQ ID NO: 1492 - protein, 430 aa, Artificial Sequence
  source: /note="Description of Artificial Sequence: Synthetic Chimeric Antigen Receptor sequence"
MALPVTALLLPLALLLHAARPGSGSGAQAAQVQLVQSGAEVKKPGASVKVSCKASGYSFPDYYINWVRQAPGQGLEWMGWIYFASGNSEYNQKFTGRVTMTRDTSSSTAYMELSSLRSEDTAVYFCASLYDYDWYFDVWGQGTMVTVSSGGGGSGGGGSGGGGSDIVMTQTPLSLSVTPGEPASISCKSSQSLVHSNGNTYLHWYLQKPGQSPQLLIYKVSNRFSGVPDRFSGSGSGADFTLKISRVEAEDVGVYYCAETSHVPWTFGQGTKLEIKRSDPASGAGSGSGSAPYEWSNSSDPLLVSVTGNPSNSWPSPTEPSSETGNPRHLHVLIGTSVVIILFILLLFFLLHRWCCNKKNAVVMDQEPAGNRTVNREDSDEQDPQEVTYAQLNHCVFTQRKITRPSQRPKTPPTDIIVYTELPNAEPSHG

SEQ ID NO: 1493 - protein, 431 aa, Artificial Sequence
  source: /note="Description of Artificial Sequence: Synthetic Chimeric Antigen Receptor sequence"
MALPVTALLLPLALLLHAARPQVQLVQSGAEVKKPGASVKVSCKASGYSFPDYYINWVRQAPGQGLEWMGWIYFASGNSEYNQKFTGRVTMTRDTSSSTAYMELSSLRSEDTAVYFCASLYDYDWYFDVWGQGTMVTVSSGGGGSGGGGSGGGGSDIVMTQTPLSLSVTPGEPASISCKSSQSLVHSNGNTYLHWYLQKPGQSPQLLIYKVSNRFSGVPDRFSGSGSGADFTLKISRVEAEDVGVYYCAETSHVPWTFGQGTKLEIKYPLTFGAGTMLDLKRAAATERRAEVPTAHPSPSPRPAGQFQTLVVGVVGGLLGSLVLLVWVLAVICSRAARGTIGARRTGQPLKEDPSAVPVFSVDYGELDFQWREKTPEPPVPCVPEQTEYATIVFPSGMGTSSPARRGSADGPRSAQPLRPEDGHCSWPLSH

SEQ ID NO: 1494 - protein, 432 aa, Artificial Sequence
  source: /note="Description of Artificial Sequence: Synthetic Chimeric Antigen Receptor sequence"
MALPVTALLLPLALLLHAARPGSGSGAQAAQVQLVQSGAEVKKPGASVKVSCKASGYSFPDYYINWVRQAPGQGLEWMGWIYFASGNSEYNQKFTGRVTMTRDTSSSTAYMELSSLRSEDTAVYFCASLYDYDWYFDVWGQGTMVTVSSGGGGSGGGGSGGGGSDIVMTQTPLSLSVTPGEPASISCKSSQSLVHSNGNTYLHWYLQKPGQSPQLLIYKVSNRFSGVPDRFSGSGSGADFTLKISRVEAEDVGVYYCAETSHVPWTFGQGTKLEIKRSDPASGAGSGSGSALNFTVPTGARSNHLTSGVIEGLLSTLGPATVALLFCYGLKRKIGRRSARDPLRSLPSPLPQEFTYLNSPTPGQLQPIYENVNVVSGDEVYSLAYYNQPEQESVAAETLGTHMEDKVSLDIYSRLRKANITDVDYEDAMSHG

SEQ ID NO: 1495 - protein, 435 aa, Artificial Sequence
  source: /note="Description of Artificial Sequence: Synthetic Chimeric Antigen Receptor sequence"
MALPVTALLLPLALLLHAARPGSGSGAQAAQVQLVQSGAEVKKPGASVKVSCKASGYSFPDYYINWVRQAPGQGLEWMGWIYFASGNSEYNQKFTGRVTMTRDTSSSTAYMELSSLRSEDTAVYFCASLYDYDWYFDVWGQGTMVTVSSGGGGSGGGGSGGGGSDIVMTQTPLSLSVTPGEPASISCKSSQSLVHSNGNTYLHWYLQKPGQSPQLLIYKVSNRFSGVPDRFSGSGSGADFTLKISRVEAEDVGVYYCAETSHVPWTFGQGTKLEIKRSDPASGAGSGSGSAVTVRETPGNRDGLVAAGATGGLLSALLLAVALLFHCWRRRKSGVGFLGDETRLPPAPGPGESSHSICPAQVELQSLYVDVHPKKGDLVYSEIQTTQLGEEEEANTSRTLLEDKDVSVVYSEVKTQHPDNSAGKISSKDEESSHG

SEQ ID NO: 1496 - protein, 437 aa, Artificial Sequence
  source: /note="Description of Artificial Sequence: Synthetic Chimeric Antigen Receptor sequence"
MALPVTALLLPLALLLHAARPGSGSGAQAAQVQLVQSGAEVKKPGASVKVSCKASGYSFPDYYINWVRQAPGQGLEWMGWIYFASGNSEYNQKFTGRVTMTRDTSSSTAYMELSSLRSEDTAVYFCASLYDYDWYFDVWGQGTMVTVSSGGGGSGGGGSGGGGSDIVMTQTPLSLSVTPGEPASISCKSSQSLVHSNGNTYLHWYLQKPGQSPQLLIYKVSNRFSGVPDRFSGSGSGADFTLKISRVEAEDVGVYYCAETSHVPWTFGQGTKLEIKRSDPASGAGSGSGSALYITGLTANRSGPFATGVAGGLLSIAGLAAGALLLYCWLSRKAGRKPASDPARSPPDSDSQEPTYHNVPAWEELQPVYTNANPRGENVVYSEVRIIQEKKKHAVASDPRHLRNKGSPIIYSEVKVASTPVSGSLFLASSAPHRSHG

SEQ ID NO: 1497 - protein, 437 aa, Artificial Sequence
  source: /note="Description of Artificial Sequence: Synthetic Chimeric Antigen Receptor sequence"
MALPVTALLLPLALLLHAARPGSGSGAQAAQVQLVQSGAEVKKPGASVKVSCKASGYSFPDYYINWVRQAPGQGLEWMGWIYFASGNSEYNQKFTGRVTMTRDTSSSTAYMELSSLRSEDTAVYFCASLYDYDWYFDVWGQGTMVTVSSGGGGSGGGGSGGGGSDIVMTQTPLSLSVTPGEPASISCKSSQSLVHSNGNTYLHWYLQKPGQSPQLLIYKVSNRFSGVPDRFSGSGSGADFTLKISRVEAEDVGVYYCAETSHVPWTFGQGTKLEIKRSDPASGAGSGSGSAPYEWSKSSDPLLVSVTGNPSNSWPSPTEPSSKTGNPRHLHILIGTSVVIILFILLFFLLHRWCSNKKNAAVMDQESAGNRTANSEDSDEQDPQEVTYTQLNHCVFTQRKITRPSQRPKTPPTDIIVYTELPNAESRSKVVSCPSHG

SEQ ID NO: 1498 - protein, 437 aa, Artificial Sequence
  source: /note="Description of Artificial Sequence: Synthetic Chimeric Antigen Receptor sequence"
MALPVTALLLPLALLLHAARPGSGSGAQAAQVQLVQSGAEVKKPGASVKVSCKASGYSFPDYYINWVRQAPGQGLEWMGWIYFASGNSEYNQKFTGRVTMTRDTSSSTAYMELSSLRSEDTAVYFCASLYDYDWYFDVWGQGTMVTVSSGGGGSGGGGSGGGGSDIVMTQTPLSLSVTPGEPASISCKSSQSLVHSNGNTYLHWYLQKPGQSPQLLIYKVSNRFSGVPDRFSGSGSGADFTLKISRVEAEDVGVYYCAETSHVPWTFGQGTKLEIKRSDPASGAGSGSGSAPYEWSNSSDPLLVSVIGNPSNSWPSPTEPSSKTGNPRHLHILIGTSVVIILFILLFFLLHRWCSNKKNAAVMDQESAGNRTANSEDSDEQDPQEVTYTQLNHCVFTQRKITRPSQRPKTPPTDIIVYAELPNAESRSKVVSCPSHG

SEQ ID NO: 1499 - protein, 437 aa, Artificial Sequence
  source: /note="Description of Artificial Sequence: Synthetic Chimeric Antigen Receptor sequence"
MALPVTALLLPLALLLHAARPGSGSGAQAAQVQLVQSGAEVKKPGASVKVSCKASGYSFPDYYINWVRQAPGQGLEWMGWIYFASGNSEYNQKFTGRVTMTRDTSSSTAYMELSSLRSEDTAVYFCASLYDYDWYFDVWGQGTMVTVSSGGGGSGGGGSGGGGSDIVMTQTPLSLSVTPGEPASISCKSSQSLVHSNGNTYLHWYLQKPGQSPQLLIYKVSNRFSGVPDRFSGSGSGADFTLKISRVEAEDVGVYYCAETSHVPWTFGQGTKLEIKRSDPASGAGSGSGSAERRAEVPTAHPSPSPRPAGQFQTLVVGVVGGLLGSLVLLVWVLAVICSRAARGTIGARRTGQPLKEDPSAVPVFSVDYGELDFQWREKTPEPPVPCVPEQTEYATIVFPSGMGTSSPARRGSADGPRSAQPLRPEDGHCSWPLSHG

SEQ ID NO: 1500 - protein, 438 aa, Artificial Sequence
  source: /note="Description of Artificial Sequence: Synthetic Chimeric Antigen Receptor sequence"
MALPVTALLLPLALLLHAARPGSGSGAQAAQVQLVQSGAEVKKPGASVKVSCKASGYSFPDYYINWVRQAPGQGLEWMGWIYFASGNSEYNQKFTGRVTMTRDTSSSTAYMELSSLRSEDTAVYFCASLYDYDWYFDVWGQGTMVTVSSGGGGSGGGGSGGGGSDIVMTQTPLSLSVTPGEPASISCKSSQSLVHSNGNTYLHWYLQKPGQSPQLLIYKVSNRFSGVPDRFSGSGSGADFTLKISRVEAEDVGVYYCAETSHVPWTFGQGTKLEIKRSDPASGAGSGSGSAPYEWSDPSDPLLVSVTGNPSSSWPSPTEPSSKSGNPRHLHILIGTSVVIILFILLLFFLLHLWCSNKKNAAVMDQEPAGNRTANSEDSDEQDPEEVTYAQLDHCVFTQRKITRPSQRPKTPPTDTILYTELPNAKPRSKVVSCPSHG

SEQ ID NO: 1501 - protein, 441 aa, Artificial Sequence
  source: /note="Description of Artificial Sequence: Synthetic Chimeric Antigen Receptor sequence"
MALPVTALLLPLALLLHAARPGSGSGAQAAQVQLVQSGAEVKKPGASVKVSCKASGYSFPDYYINWVRQAPGQGLEWMGWIYFASGNSEYNQKFTGRVTMTRDTSSSTAYMELSSLRSEDTAVYFCASLYDYDWYFDVWGQGTMVTVSSGGGGSGGGGSGGGGSDIVMTQTPLSLSVTPGEPASISCKSSQSLVHSNGNTYLHWYLQKPGQSPQLLIYKVSNRFSGVPDRFSGSGSGADFTLKISRVEAEDVGVYYCAETSHVPWTFGQGTKLEIKRSDPASGAGSGSGSAVRVILAPWKKGLIAVVIIGVIIALLIIAAKCYFLRKAKAKQMPVEMSRPAVPLLNSNNEKMSDPNMEANSHYGHNDDVGNHAMKPINDNKEPLNSDVQYTEVQVSSAESHKDLGKKDTETVYSEVRKAVPDAVESRYSRTEGSLDGTSHG

SEQ ID NO: 1502 - protein, 447 aa, Artificial Sequence
  source: /note="Description of Artificial Sequence: Synthetic Chimeric Antigen Receptor sequence"
MALPVTALLLPLALLLHAARPGSGSGAQAAQVQLVQSGAEVKKPGASVKVSCKASGYSFPDYYINWVRQAPGQGLEWMGWIYFASGNSEYNQKFTGRVTMTRDTSSSTAYMELSSLRSEDTAVYFCASLYDYDWYFDVWGQGTMVTVSSGGGGSGGGGSGGGGSDIVMTQTPLSLSVTPGEPASISCKSSQSLVHSNGNTYLHWYLQKPGQSPQLLIYKVSNRFSGVPDRFSGSGSGADFTLKISRVEAEDVGVYYCAETSHVPWTFGQGTKLEIKRSDPASGAGSGSGSAQAVTTTTQRPSSMTTTWRLSSTTTTTGLRVTQGKRRSDSWHISLETAVGVAVAVTVLGIMILGLICLLRWRRRKGQQRTKATTPAREPFQNTEEPYENIRNEGQNTDPKLNPKDDGIVYASLALSSSTSPKAPPSHRPLKSPQNETLYSVLKASHG

SEQ ID NO: 1503 - protein, 449 aa, Artificial Sequence
  source: /note="Description of Artificial Sequence: Synthetic Chimeric Antigen Receptor sequence"
MALPVTALLLPLALLLHAARPGSGSGAQAAQVQLVQSGAEVKKPGASVKVSCKASGYSFPDYYINWVRQAPGQGLEWMGWIYFASGNSEYNQKFTGRVTMTRDTSSSTAYMELSSLRSEDTAVYFCASLYDYDWYFDVWGQGTMVTVSSGGGGSGGGGSGGGGSDIVMTQTPLSLSVTPGEPASISCKSSQSLVHSNGNTYLHWYLQKPGQSPQLLIYKVSNRFSGVPDRFSGSGSGADFTLKISRVEAEDVGVYYCAETSHVPWTFGQGTKLEIKRSDPASGAGSGSGSAPCVWSNSSDPLLVSVTGNPSSSWPSPTEPSSKSGICRHLHVLIGTSVVIFLFILLLFFLLYRWCSNKKNAAVMDQEPAGDRTVNRQDSDEQDPQEVTYAQLDHCVFIQRKISRPSQRPKTPLTDTSVYTELPNAEPRSKVVSCPRAPQSGLEGVFSHG

SEQ ID NO: 1504 - protein, 449 aa, Artificial Sequence
  source: /note="Description of Artificial Sequence: Synthetic Chimeric Antigen Receptor sequence"
MALPVTALLLPLALLLHAARPGSGSGAQAAQVQLVQSGAEVKKPGASVKVSCKASGYSFPDYYINWVRQAPGQGLEWMGWIYFASGNSEYNQKFTGRVTMTRDTSSSTAYMELSSLRSEDTAVYFCASLYDYDWYFDVWGQGTMVTVSSGGGGSGGGGSGGGGSDIVMTQTPLSLSVTPGEPASISCKSSQSLVHSNGNTYLHWYLQKPGQSPQLLIYKVSNRFSGVPDRFSGSGSGADFTLKISRVEAEDVGVYYCAETSHVPWTFGQGTKLEIKRSDPASGAGSGSGSALQNEGTGTSRPVSQVTLAAVGGAGATALAFLSFCIIFIIVRSCRKKSARPAAGVGDTGMEDAKAIRGSASQGPLTESWKDGNPLKKPPPAVAPSSGEEGELHYATLSFHKVKPQDPQGQEATDSEYSEIKIHKRETAETQACLRNHNPSSKEVRGSHG

SEQ ID NO: 1505 - protein, 465 aa, Artificial Sequence
  source: /note="Description of Artificial Sequence: Synthetic Chimeric Antigen Receptor sequence"
MALPVTALLLPLALLLHAARPGSGSGAQAAQVQLVQSGAEVKKPGASVKVSCKASGYSFPDYYINWVRQAPGQGLEWMGWIYFASGNSEYNQKFTGRVTMTRDTSSSTAYMELSSLRSEDTAVYFCASLYDYDWYFDVWGQGTMVTVSSGGGGSGGGGSGGGGSDIVMTQTPLSLSVTPGEPASISCKSSQSLVHSNGNTYLHWYLQKPGQSPQLLIYKVSNRFSGVPDRFSGSGSGADFTLKISRVEAEDVGVYYCAETSHVPWTFGQGTKLEIKRSDPASGAGSGSGSAGTSRNRTGLTAAGITGLVLSILVLAAAAALLHYARARRKPGGLSATGTSSHSPSECQEPSSSRPSRIDPQEPTHSKPLAPMELEPMYSNANPGDSNPIYSQIWSIQHTKENSANCPMMHQEHEELTVLYSELKKTHPDDSAGEASSRGRAHEEDDEENYENVPRVLLASDHSHG

SEQ ID NO: 1506 - protein, 466 aa, Artificial Sequence
  source: /note="Description of Artificial Sequence: Synthetic Chimeric Antigen Receptor sequence"
MALPVTALLLPLALLLHAARPGSGSGAQAAQVQLVQSGAEVKKPGASVKVSCKASGYSFPDYYINWVRQAPGQGLEWMGWIYFASGNSEYNQKFTGRVTMTRDTSSSTAYMELSSLRSEDTAVYFCASLYDYDWYFDVWGQGTMVTVSSGGGGSGGGGSGGGGSDIVMTQTPLSLSVTPGEPASISCKSSQSLVHSNGNTYLHWYLQKPGQSPQLLIYKVSNRFSGVPDRFSGSGSGADFTLKISRVEAEDVGVYYCAETSHVPWTFGQGTKLEIKRSDPASGAGSGSGSAGPSGDPSLSPTGSTPTPGPEDQPLTPTGLDPQSGLGRHLGVVTGVSVAFVLLLFLLLFLLLRHRHQSKHRTSAHFYRPAGAAGPEPKDQGLQKRASPVADIQEEILNAAVKDTQPKDGVEMDARAAASEAPQDVTYAQLHSLTLRREATEPPPSQEREPPAEPSIYAPLAIHSHG

SEQ ID NO: 1507 - protein, 469 aa, Artificial Sequence
  source: /note="Description of Artificial Sequence: Synthetic Chimeric Antigen Receptor sequence"
MALPVTALLLPLALLLHAARPGSGSGAQAAQVQLVQSGAEVKKPGASVKVSCKASGYSFPDYYINWVRQAPGQGLEWMGWIYFASGNSEYNQKFTGRVTMTRDTSSSTAYMELSSLRSEDTAVYFCASLYDYDWYFDVWGQGTMVTVSSGGGGSGGGGSGGGGSDIVMTQTPLSLSVTPGEPASISCKSSQSLVHSNGNTYLHWYLQKPGQSPQLLIYKVSNRFSGVPDRFSGSGSGADFTLKISRVEAEDVGVYYCAETSHVPWTFGQGTKLEIKRSDPASGAGSGSGSAPYEWSDASDPLPVSVTGNPSSSWPSPTEPSFKTGIARHLHAVIRYSVAIILFTILPFFLLHRWCSKKKDAAVMNQEPAGHRTVNREDSDEQDPQEVTYAQLDHCIFTQRKITGPSQRSKRPSTDTSVCIELPNAEPRALSPAHEHHSQALMGSSRETTALSQTQLASSHVPAAGISHG

SEQ ID NO: 1508 - protein, 469 aa, Artificial Sequence
  source: /note="Description of Artificial Sequence: Synthetic Chimeric Antigen Receptor sequence"
MALPVTALLLPLALLLHAARPGSGSGAQAAQVQLVQSGAEVKKPGASVKVSCKASGYSFPDYYINWVRQAPGQGLEWMGWIYFASGNSEYNQKFTGRVTMTRDTSSSTAYMELSSLRSEDTAVYFCASLYDYDWYFDVWGQGTMVTVSSGGGGSGGGGSGGGGSDIVMTQTPLSLSVTPGEPASISCKSSQSLVHSNGNTYLHWYLQKPGQSPQLLIYKVSNRFSGVPDRFSGSGSGADFTLKISRVEAEDVGVYYCAETSHVPWTFGQGTKLEIKRSDPASGAGSGSGSAPYEWSDPSDPLLVSVTGNSSSSSSSPTEPSSKTGIRRHLHILIGTSVAIILFIILFFFLLHCCCSNKKNAAVMDQEPAGDRTVNREDSDDQDPQEVTYAQLDHCVFTQTKITSPSQRPKTPPTDTTMYMELPNAKPRSLSPAHKHHSQALRGSSRETTALSQNRVASSHVPAAGISHG

SEQ ID NO: 1509 - protein, 473 aa, Artificial Sequence
  source: /note="Description of Artificial Sequence: Synthetic Chimeric Antigen Receptor sequence"
MALPVTALLLPLALLLHAARPGSGSGAQAAQVQLVQSGAEVKKPGASVKVSCKASGYSFPDYYINWVRQAPGQGLEWMGWIYFASGNSEYNQKFTGRVTMTRDTSSSTAYMELSSLRSEDTAVYFCASLYDYDWYFDVWGQGTMVTVSSGGGGSGGGGSGGGGSDIVMTQTPLSLSVTPGEPASISCKSSQSLVHSNGNTYLHWYLQKPGQSPQLLIYKVSNRFSGVPDRFSGSGSGADFTLKISRVEAEDVGVYYCAETSHVPWTFGQGTKLEIKRSDPASGAGSGSGSAGPSMGSSPPPTGPISTPAGPEDQPLTPTGSDPQSGLGRHLGVVIGILVAVVLLLLLLLLLFLILRHRRQGKHWTSTQRKADFQHPAGAVGPEPTDRGLQWRSSPAADAQEENLYAAVKDTQPEDGVEMDTRAAASEAPQDVTYAQLHSLTLRRKATEPPPSQEREPPAEPSIYATLAIHSHG

SEQ ID NO: 1510 - protein, 500 aa, Artificial Sequence
  source: /note="Description of Artificial Sequence: Synthetic Chimeric Antigen Receptor sequence"
MALPVTALLLPLALLLHAARPGSGSGAQAAQVQLVQSGAEVKKPGASVKVSCKASGYSFPDYYINWVRQAPGQGLEWMGWIYFASGNSEYNQKFTGRVTMTRDTSSSTAYMELSSLRSEDTAVYFCASLYDYDWYFDVWGQGTMVTVSSGGGGSGGGGSGGGGSDIVMTQTPLSLSVTPGEPASISCKSSQSLVHSNGNTYLHWYLQKPGQSPQLLIYKVSNRFSGVPDRFSGSGSGADFTLKISRVEAEDVGVYYCAETSHVPWTFGQGTKLEIKRSDPASGAGSGSGSAKNESAASSTGKTPAAEETVTTILGMLASPYHYLIIIVVLVIILAVVVVGFSCRKKFISYLKGICSGGGGGPERVHRVLFRRRSCPSRVPGAEDNARNETLSNRYLQPTQVSEQEIQGQELAELTGVTVELPEEPQRLLEQAEAEGCQRRRLLVPVNDADSADISTLLDASATLEEGHAKETIQDQLVGSEKLFYEEDEAGSATSCLSHG

SEQ ID NO: 1511 - protein, 506 aa, Artificial Sequence
  source: /note="Description of Artificial Sequence: Synthetic Chimeric Antigen Receptor sequence"
MALPVTALLLPLALLLHAARPGSGSGAQAAQVQLVQSGAEVKKPGASVKVSCKASGYSFPDYYINWVRQAPGQGLEWMGWIYFASGNSEYNQKFTGRVTMTRDTSSSTAYMELSSLRSEDTAVYFCASLYDYDWYFDVWGQGTMVTVSSGGGGSGGGGSGGGGSDIVMTQTPLSLSVTPGEPASISCKSSQSLVHSNGNTYLHWYLQKPGQSPQLLIYKVSNRFSGVPDRFSGSGSGADFTLKISRVEAEDVGVYYCAETSHVPWTFGQGTKLEIKRSDPASGAGSGSGSAGHSGGSSLPPTGPPSTPGLGRYLEVLIGVSVAFVLLLFLLLFLLLRRQRHSKHRTSDQRKTDFQRPAGAAETEPKDRGLLRRSSPAADVQEENLYAAVKDTQSEDRVELDSQSPHDEDPQAVTYAPVKHSSPRREMASPPSSLSGEFLDTKDRQVEEDRQMDTEAAASEASQDVTYAQLHSLTLRRKATEPPPSQEGEPPAEPSIYATLAIHSHG

SEQ ID NO: 1512 - protein, 515 aa, Artificial Sequence
  source: /note="Description of Artificial Sequence: Synthetic Chimeric Antigen Receptor sequence"
MALPVTALLLPLALLLHAARPGSGSGAQAAQVQLVQSGAEVKKPGASVKVSCKASGYSFPDYYINWVRQAPGQGLEWMGWIYFASGNSEYNQKFTGRVTMTRDTSSSTAYMELSSLRSEDTAVYFCASLYDYDWYFDVWGQGTMVTVSSGGGGSGGGGSGGGGSDIVMTQTPLSLSVTPGEPASISCKSSQSLVHSNGNTYLHWYLQKPGQSPQLLIYKVSNRFSGVPDRFSGSGSGADFTLKISRVEAEDVGVYYCAETSHVPWTFGQGTKLEIKRSDPASGAGSGSGSAVYSLPQLLGPSCSWEAEGLHCRCSFRAWPAPSLCWRLEEKPLEGNSSQGSFKVNSSSPGPWANSSLILHGGLNSDLKVSCKAWNIYGSQSGSVLLLQGRSNLGTGVVPAALGGAGVMALLCICLCLIFFLIVKARRKQAAGRPEKMDDEDPIMGTITSGSRKKPWPDSPGDQASPPGDAPPLEEQKELHYASLSFSEMKSREPKDQEAPSTTEYSEIKTSKSHG

SEQ ID NO: 1513 - protein, 524 aa, Artificial Sequence
  source: /note="Description of Artificial Sequence: Synthetic Chimeric Antigen Receptor sequence"
MALPVTALLLPLALLLHAARPGSGSGAQAAQVQLVQSGAEVKKPGASVKVSCKASGYSFPDYYINWVRQAPGQGLEWMGWIYFASGNSEYNQKFTGRVTMTRDTSSSTAYMELSSLRSEDTAVYFCASLYDYDWYFDVWGQGTMVTVSSGGGGSGGGGSGGGGSDIVMTQTPLSLSVTPGEPASISCKSSQSLVHSNGNTYLHWYLQKPGQSPQLLIYKVSNRFSGVPDRFSGSGSGADFTLKISRVEAEDVGVYYCAETSHVPWTFGQGTKLEIKRSDPASGAGSGSGSAGSLEGPRPSPTRSVSTAAGPEDQPLMPTGSVPHSGLRRHWEVLIGVLVVSILLLSLLLFLLLQHWRQGKHRTLAQRQADFQRPPGAAEPEPKDGGLQRRSSPAADVQGENFCAAVKNTQPEDGVEMDTRQSPHDEDPQAVTYAKVKHSRPRREMASPPSPLSGEFLDTKDRQAEEDRQMDTEAAASEAPQDVTYAQLHSFTLRQKATEPPPSQEGASPAEPSVYATLAIHSHG

SEQ ID NO: 1514 - protein, 533 aa, Artificial Sequence
  source: /note="Description of Artificial Sequence: Synthetic Chimeric Antigen Receptor sequence"
MALPVTALLLPLALLLHAARPGSGSGAQAAQVQLVQSGAEVKKPGASVKVSCKASGYSFPDYYINWVRQAPGQGLEWMGWIYFASGNSEYNQKFTGRVTMTRDTSSSTAYMELSSLRSEDTAVYFCASLYDYDWYFDVWGQGTMVTVSSGGGGSGGGGSGGGGSDIVMTQTPLSLSVTPGEPASISCKSSQSLVHSNGNTYLHWYLQKPGQSPQLLIYKVSNRFSGVPDRFSGSGSGADFTLKISRVEAEDVGVYYCAETSHVPWTFGQGTKLEIKRSDPASGAGSGSGSAVHKESGNGHNIWVILVVTLVVPLLLVAVLIVCCCIGSGCGGDPKCMDRVCFWRLGLLRGPGAEDNAHNEILSNADSLSTFVSEQQMESQEPADLTGVTVQSPGEAQCLLGPAEAEGSQRRRLLVPANGADPTETLMLFFDKFANIVPFDSWDQLMRQLDLTKNEIDVVRAGTAGPGDALYAMLMKWVNKTGRNASIHTLLDALERMEERHAKEKIQDLLVDSGKFIYLEDGTGSAVSLESHG

SEQ ID NO: 1515 - protein, 540 aa, Artificial Sequence
  source: /note="Description of Artificial Sequence: Synthetic Chimeric Antigen Receptor sequence"
MALPVTALLLPLALLLHAARPGSGSGAQAAQVQLVQSGAEVKKPGASVKVSCKASGYSFPDYYINWVRQAPGQGLEWMGWIYFASGNSEYNQKFTGRVTMTRDTSSSTAYMELSSLRSEDTAVYFCASLYDYDWYFDVWGQGTMVTVSSGGGGSGGGGSGGGGSDIVMTQTPLSLSVTPGEPASISCKSSQSLVHSNGNTYLHWYLQKPGQSPQLLIYKVSNRFSGVPDRFSGSGSGADFTLKISRVEAEDVGVYYCAETSHVPWTFGQGTKLEIKRSDPASGAGSGSGSAVHYPPQLLGPSCSWEAEGLHCSCSSQASPAPSLRWWLGEELLEGNSSQGSFEVTPSSAGPWANSSLSLHGGLSSGLRLRCKAWNVHGAQSGSVFQLLPGKLEHGGGLGLGAALGAGVAALLAFCSCLVVFRVKICRKEARKRAAAEQDVPSTLGPISQGHQHECSAGSSQDHPPPGAATYTPGKGEEQELHYASLSFQGLRLWEPADQEAPSTTEYSEIKIHTGQPLRGPGFGLQLEREMSGMVPKSHG

SEQ ID NO: 1516 - protein, 550 aa, Artificial Sequence
  source: /note="Description of Artificial Sequence: Synthetic Chimeric Antigen Receptor sequence"
MALPVTALLLPLALLLHAARPGSGSGAQAAQVQLVQSGAEVKKPGASVKVSCKASGYSFPDYYINWVRQAPGQGLEWMGWIYFASGNSEYNQKFTGRVTMTRDTSSSTAYMELSSLRSEDTAVYFCASLYDYDWYFDVWGQGTMVTVSSGGGGSGGGGSGGGGSDIVMTQTPLSLSVTPGEPASISCKSSQSLVHSNGNTYLHWYLQKPGQSPQLLIYKVSNRFSGVPDRFSGSGSGADFTLKISRVEAEDVGVYYCAETSHVPWTFGQGTKLEIKRSDPASGAGSGSGSAVHYSPKLLGPSCSWEAEGLHCSCSSQASPAPSLRWWLGEELLEGNSSQDSFEVTPSSAGPWANSSLSLHGGLSSGLRLRCEAWNVHGAQSGSILQLPDKKGLISTAFSNGAFLGIGITALLFLCLALIIMKILPKRRTQTETPRPRFSRHSTILDYINVVPTAGPLAQKRNQKATPNSPRTPLPPGAPSPESKKNQKKQYQLPSFPEPKSSTQAPESQESQEELHYATLNFPGVRPRPEARMPKGTQADYAEVKFQSHG

SEQ ID NO: 1517 - protein, 556 aa, Artificial Sequence
  source: /note="Description of Artificial Sequence: Synthetic Chimeric Antigen Receptor sequence"
MALPVTALLLPLALLLHAARPGSGSGAQAAQVQLVQSGAEVKKPGASVKVSCKASGYSFPDYYINWVRQAPGQGLEWMGWIYFASGNSEYNQKFTGRVTMTRDTSSSTAYMELSSLRSEDTAVYFCASLYDYDWYFDVWGQGTMVTVSSGGGGSGGGGSGGGGSDIVMTQTPLSLSVTPGEPASISCKSSQSLVHSNGNTYLHWYLQKPGQSPQLLIYKVSNRFSGVPDRFSGSGSGADFTLKISRVEAEDVGVYYCAETSHVPWTFGQGTKLEIKRSDPASGAGSGSGSAVHKESGTKHSGEAPAVEETVTSSPGTPASPCSLSGIIIGVTVAAVVLIVAVFVCKSLLWKKVLPYLKGICSGGGGDPERVDRSSQRPGAEDNVLNEIVSILQPTQVPEQEMEVQEPAEPTGVNMLSPGESEHLLEPAEAERSQRRRLLVPANEGDPTETLRQCFDDFADLVPFDSWEPLMRKLGLMDNEIKVAKAEAAGHRDTLYTMLIKWVNKTGRDASVHTLLDALETLGERLAKQKIEDHLLSSGKFMYLEGNADSAMSSHG

SEQ ID NO: 1518 - protein, 741 aa, Artificial Sequence
  source: /note="Description of Artificial Sequence: Synthetic Chimeric Antigen Receptor sequence"
MSELIKENMHMKLYMEGTVDNHHFKCTSEGEGKPYEGTQTMRIKVVEGGPLPFAFDILATSFLYGSKTFINHTQGIPDFFKQSFPEGFTWERVTTYEDGGVLTATQDTSLQDGCLIYNVKIRGVNFTSNGPVMQKKTLGWEAFTETLYPADGGLEGRNDMALKLVGGSHLIANIKTTYRSKKPAKNLKMPGVYYVDYRLERIKEANNETYVEQHEVAVARYCDLPSKLGHKLNRAEGRGSLLTCGDVEENPGPMALPVTALLLPLALLLHAARPEVQLVESGGGLVQPGRSLRLSCAASGFTFNDYAMHWVRQAPGKGLEWVSTISWNSGSIGYADSVKGRFTISRDNAKKSLYLQMNSLRAEDTALYYCAKDIQYGNYYYGMDVWGQGTTVTVSSGGGGSGGGGSGGGGSEIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTRLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1519 - protein, 1352 aa, Artificial Sequence
  source: /note="Description of Artificial Sequence: Synthetic Chimeric Antigen Receptor sequence"
MSLPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITKAGGGGSGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKIVINSLQTDDTAIYYCAKHYYYGGSYAMDYWGQGTSVTVSSDPTTTPAPRPPTPAPTIASQPLSLRPEACRPAAGGAVHTRGLDFACDIFWVLVVVGGVLACYSLLVTVAFIIFWVRRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRRAEGRGSLLTCGDVEENPGPMAVPTQVLGLLLLWLTDARCDIQMTQSPSSLSASVGDRVTITCRASEDIYFNLVWYQQKPGKAPKLLIYDTNRLADGVPSRFSGSGSGTQYTLTISSLQPEDFATYYCQHYKNYPLTFGQGTKLEIKRSGGGGSGGGGSGGGGSGGGGSRSEVQLVESGGGLVQPGGSLRLSCAASGFTLSNYGMHWIRQAPGKGLEWVSSISLNGGSTYYRDSVKGRFTISRDNAKSTLYLQMNSLRAEDTAVYYCAAQDAYTGGYFDYWGQGTLVTVSSMDPAEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKKDPKAVFGCIFGALVIVTVGGFIFWRKKRKDAKNNEVSFSQIKPKKSKLIRVENFEAYFKKQQADSNCGFAEEYEDLKLVGISQPKYAAELAENRGKNRYNNVLPYDISRVKLSVQTHSTDDYINANYMPGYHSKKDFIATQGPLPNTLKDFWRMVWEKNVYAIIMLTKCVEQGRTKCEEYWPSKQAQDYGDITVAMTSEIVLPEWTIRDFTVKNIQTSESHPLRQFHFTSWPDHGVPDTTDLLINFRYLVRDYMKQSPPESPILVHCSAGVGRTGTFIAIDRLIYQIENENTVDVYGIVYDLRMHRPLMVQTEDQYVFLNQCVLDIVRSQKDSKVDLIYQNTTAMTIYENLAPVTTFGKTNGYIA

SEQ ID NO: 1520 - protein, 1341 aa, Artificial Sequence
  source: /note="Description of Artificial Sequence: Synthetic Chimeric Antigen Receptor sequence"
MSLPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTEGGGTKLEITKAGGGGSGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSDPTTTPAPRPPTPAPTIASQPLSLRPEACRPAAGGAVHTRGLDFACDIFWVLVVVGGVLACYSLLVTVAFIIEWVRRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRRAEGRGSLLTCGDVEENPGPMETDTLLLWVLLLWVPGSTGQVTLKESGPGILKPSQTLSLTCSFSGESLSTSGMGVGWIRQPSGKGLEWLAHIWWDDDVYYNPSLKNQLTISKDASRDQVFLKITNLDTADTATYYCVRRRATGTGEDYWGQGTTLTVSSGGGGSGGGGSGGGGSNIVMTQSHKFMSTSVGDRVSIACKASQDVGTAVAWYQQKPGQSPKLLIYWTSTRHTGVPDRFTGSGSGTDFTLTITNVQSEDLADYFCHQYNSYNTFGSGTRLELKRSDPAEPKSPDKTHTCPPCPAPPVAGPSVFLEPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVESCSVMHEALHNHYTQKSLSLSPGKKDPKAVFGCIFGALVIVTVGGFIFWRKKRKDAKNNEVSFSQIKPKKSKLIRVENFEAYFKKQQADSNCGFAEEYEDLKLVGISQPKYAAELAENRGKNRYNNVLPYDISRVKLSVQTHSTDDYINANYMPGYHSKKDFIATQGPLPNTLKDFWRMVWEKNVYAIIMLTKCVEQGRTKCEEYWPSKQAQDYGDITVAMTSEIVLPEWTIRDFTVKNIQTSESHPLRQFHFTSWPDHGVPDTTDLLINFRYLVRDYMKQSPPESPILVHCSAGVGRTGTFIAIDRLIYQIENENTVDVYGIVYDLRMHRPLMVQTEDQYVFLNQCVLDIVRSQKDSKVDLIYQNTTAMTIYENLAPVTTFGKTNGYIA

SEQ ID NO: 1521 - protein, 1342 aa, Artificial Sequence [sequence omitted]

SEQ ID NO: 1522 - protein, 1341 aa, Artificial Sequence
  source: /note="Description of Artificial Sequence: Synthetic Chimeric Antigen Receptor sequence"
MSLPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTEGGGTKLEITKAGGGGSGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSDPTTTPAPRPPTPAPTIASQPLSLRPEACRPAAGGAVHTRGLDFACDIFWVLVVVGGVLACYSLLVTVAFIIFWVRRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRRAEGRGSLLTCGDVEENPGPMETDTLLLWVLLLWVPGSTGQVQLQESGPGLVKPSQTLSITCTVSGFSLASYNIHWVRQPPGKGLEWLGVIWAGGSTNYNSALMSRLTISKDNSKNQVFLKMSSLTAADTAVYYCAKRSDDYSWFAYWGQGTLVTVSSGGGGSGGGGSGGGGSENQMTQSPSSLSASVGDRVTMTCRASSSVSSSYLHWYQQKSGKAPKVWIYSTSNLASGVPSRFSGSGSGTDYTLTISSLQPEDFATYYCQQYSGYPITEGQGTKVEIKRSDPAEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKKDPKAVFGCIFGALVIVTVGGFIFWRKKRKDAKNNEVSFSQIKPKKSKLIRVENFEAYFKKQQADSNCGFAEEYEDLKLVGISQPKYAAELAENRGKNRYNNVLPYDISRVKLSVQTHSTDDYINANYMPGYHSKKDFIATQGPLPNTLKDFWRMVWEKNVYAIIMLTKCVEQGRTKCEEYWPSKQAQDYGDITVAMTSEIVLPEWTIRDFTVKNIQTSESHPLRQFHFTSWPDHGVPDTTDLLINFRYLVRDYMKQSPPESPILVHCSAGVGRTGTFIAIDRLIYQIENENTVDVYGIVYDLRMHRPLMVQTEDQYVFLNQCVLDIVRSQKDSKVDLIYQNTTAMTIYENLAPVTTEGKTNGYIA

SEQ ID NO: 1523 - protein, 1341 aa, Artificial Sequence [sequence omitted]

SEQ ID NO: 1524 - protein, 1113 aa, Artificial Sequence
  source: /note="Description of Artificial Sequence: Synthetic Chimeric Antigen Receptor sequence"
MSLPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITKAGGGGSGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSDPTTTPAPRPPTPAPTIASQPLSLRPEACRPAAGGAVHTRGLDFACDIFWVLVVVGGVLACYLLVTVAFIIFWVRRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRRAEGRGSLLTCGDVEENPGPMAVPTQVLGLLLLWLTDARCDIQMTQSPSSLSASVGDRVTITCRASEDIYFNLVWYQQKPGKAPKLLIYDTNRLADGVPSRFSGSGSGTQYTLTISSLQPEDFATYYCQHYKNYPLTFGQGTKLEIKRSGGGGSGGGGSGGGGSGGGGSRSEVQLVESGGGLVQPGGSLRLSCAASGFTLSNYGMHWIRQAPGKGLEWVSSISLNGGSTYYRDSVKGRFTISRDNAKSTLYLQMNSLRAEDTAVYYCAAQDAYTGGYFDYWGQGTLVTVSSMDPATTTKPVLRTPSPVHPTGTSQPQRPEDCRPRGSVKGTGLDFACDIYWAPLAGICVALLLSLIITLICYHRSRKRVCKSGGGSFWEEFESLQKQEVKNLHQRLEGQRPENKGKNRYKNILPFDHSRVILQGRDSNIPGSDYINANYIKNQLLGPDENAKTYIASQGCLEATVNDFWQMAWQENSRVIVMTTREVEKGRNKCVPYWPEVGMQRAYGPYSVTNCGEHDTTEYKLRTLQVSPLDNGDLIREIWHYQYLSWPDHGVPSEPGGVLSFLDQINQRQESLPHAGPIIVHCSAGIGRIGTIIVIDMLMENISTKGLDCDIDIQKTIQMVRAQRSGMVQTEAQYKFIYVAIAQFIETTKKKL

SEQ ID NO: 1525 - protein, 918 aa, Artificial Sequence
  source: /note="Description of Artificial Sequence: Synthetic Chimeric Antigen Receptor sequence"
MSLPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITKAGGGGSGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSDPITTPAPRPPTPAPTIASQPLSLRPEACRPAAGGAVHTRGLDFACDIFWVLVVVGGVLACYSLLVTVAFIIFWVRRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRRAEGRGSLLTCGDVEENPGPMAVPTQVLGLLLLWLTDARCDIQMTQSPSSLSASVGDRVTITCRASEDIYFNLVWYQQKPGKAPKLLIYDTNRLADGVPSRFSGSGSGTQYTLTISSLQPEDFATYYCQHYKNYPLTFGQGTKLEIKRSGGGGSGGGGSGGGGSGGGGSRSEVQLVESGGGLVQPGGSLRLSCAASGFTLSNYGMHWIRQAPGKGLEWVSSISLNGGSTYYRDSVKGRFTISRDNAKSTLYLQMNSLRAEDTAVYYCAAQDAYTGGYFDYWGQGTLVTVSSMDPATTTKPVLRTPSPVHPTGTSQPQRPEDCRPRGSVKGTGLDFACDILIGVSVVFLFCLLLLVLFCLHRQNQIKQGPPRSKDEEQKPQQRPDLAVDVLERTADKATVNGLPEKDRETDTSALAAGSSQEVTYAQLDHWALTQRTARAVSPQSTKPMAESITYAAVARH

SEQ ID NO: 1526 - protein, 1114 aa, Artificial Sequence
  source: /note="Description of Artificial Sequence: Synthetic Chimeric Antigen Receptor sequence"
MSLPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITKAGGGGSGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSDPTTTPAPRPPTPAPTIASQPLSLRPEACRPAAGGAVHTRGLDFACDIFWVLVVVGGVLACYSLLVTVAFIIFWVRRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRRAEGRGSLLTCGDVEENPGPMAVPTQVLGLLLLWLTDARCDIQMTQSPSSLSASVGDRVTITCRASEDIYFNLVWYQQKPGKAPKLLIYDTNRLADGVPSRFSGSGSGTQYTLTISSLQPEDFATYYCQHYKNYPLTFGQGTKLEIKRSGGGGSGGGGSGGGGSGGGGSRSEVQLVESGGGLVQPGGSLRLSCAASGFTLSNYGMHWIRQAPGKGLEWVSSISLNGGSTYYRDSVKGRFTISRDNAKSTLYLQMNSLRAEDTAVYYCAAQDAYTGGYFDYWGQGTLVTVSSMDPATTTKPVLRTPSPVHPTGTSQPQRPEDCRPRGSVKGTGLDFACDIYWAPLAGICVALLLSLIITLICYHRSRKRVCKSGGGSFWEEFESLQKQEVKNLHQRLEGQRPENKGKNRYKNILPFDHSRVILQGRDSNIPGSDYINANYIKNQLLGPDENAKTYIASQGCLEATVNDFWQMAWQENSRVIVMTTREVEKGRNKCVPYWPEVGMQRAYGPYSVTNCGEHDTTEYKLRTLQVSPLDNGDLIREIWHYQYLSWPDHGVPSEPGGVLSFLDQINQRQESLPHAGPIIVHCSAGIGRTGTIIVIDMLMENISTKGLDCDIDIQKTIQMVRAQRSGMVQTEAQYKFIYVAIAQFIETTKKKL

SEQ ID NO: 1527 - protein, 918 aa, Artificial Sequence
  source: /note="Description of Artificial Sequence: Synthetic Chimeric Antigen Receptor sequence"
MSLPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITKAGGGGSGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSDPTTTPAPRPPTPAPTIASQPLSLRPEACRPAAGGAVHTRGLDFACDIFWVLVVVGGVLACYSLLVTVAFIIFWVRRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRRAEGRGSLLTCGDVEENPGPMAVPTQVLGLLLLWLTDARCDIQMTQSPSSLSASVGDRVTITCRASEDIYFNLVWYQQKPGKAPKLLIYDTNRLADGVPSRFSGSGSGTQYTLTISSLQPEDFATYYCQHYKNYPLTFGQGTKLEIKRSGGGGSGGGGSGGGGSGGGGSRSEVQLVESGGGLVQPGGSLRLSCAASGFTLSNYGMHWIRQAPGKGLEWVSSISLNGGSTYYRDSVKGRFTISRDNAKSTLYLQMNSLRAEDTAVYYCAAQDAYTGGYFDYWGQGTLVTVSSMDPATTTKPVLRTPSPVHPTGTSQPQRPEDCRPRGSVKGTGLDFACDILIGVSVVFLFCLLLLVLFCLHRQNQIKQGPPRSKDEEQKPQQRPDLAVDVLERTADKATVNGLPEKDRETDTSALAAGSSQEVTYAQLDHWALTQRTARAVSPQSTKPMAESITYAAVARH

SEQ ID NO: 1528 - protein, 1362 aa, Artificial Sequence
  source: /note="Description of Artificial Sequence: Synthetic Chimeric Antigen Receptor sequence"
MSLPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITKAGGGGSGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSDPTTTPAPRPPTPAPTIASQPLSLRPEACRPAAGGAVHTRGLDFACDIFWVLVVVGGVLACYSLLVTVAFIIFWVRRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRRAEGRGSLLTCGDVEENPGPMAVPTQVLGLLLLWLTDARCDIQMTQSPSSLSASVGDRVTITCRASEDIYFNLVWYQQKPGKAPKLLIYDTNRLADGVPSRFSGSGSGTQYTLTISSLQPEDFATYYCQHYKNYPLTFGQGTKLEIKRSGGGGSGGGGSGGGGSGGGGSRSEVQLVESGGGLVQPGGSLRLSCAASGFTLSNYGMHWIRQAPGKGLEWVSSISLNGGSTYYRDSVKGRFTISRDNAKSTLYLQMNSLRAEDTAVYYCAAQDAYTGGYFDYWGQGTLVTVSSMDPTTTKPVLRTPSPVHPTGTSQPQRPEDCRPRGSVKGTGLDFACDILIGVSVVFLFCLLLLVLFCLHRQNQIKQGPPRSKDEEQKPQQRPDLAVDVLERTADKATVNGLPEKDRETDTSALAAGSSQEVTYAQLDHWALTQRTARAVSPQSTKPMAESITYAAVARHRAEGRGSLLTCGDVEENPGPWYHGHMSGGQAETLLQAKGEPWTFLVRESLSQPGDFVLSVLSDQPKAGPGSPLRVTHIKVMCEGGRYTVGGLETFDSLTDLVEHFKKTGIEEASGAFVYLRQPYSGGGGSFEAYFKKQQADSNCGFAEEYEDLKLVGISQPKYAAELAENRGKNRYNNVLPYDISRVKLSVQTHSTDDYINANYMPGYHSKKDFIATQGPLPNTLKDFWRMVWEKNVYAIIMLTKCVEQGRTKCEEYWPSKQAQDYGDITVAMTSEIVLPEWTIRDFTVKNIQTSESHPLRQFHFTSWPDHGVPDTTDLLINFRYLVRDYMKQSPPESPILVHCSAGVGRTGTFIAIDRLIYQIENENTVDVYGIVYDLRMHRPLMVQTEDQYVFLNQCVLDIVRSQKDSKVDLIYQNTTAMTIYENLAPVTTFGKTNGYIASGS

SEQ ID NO: 1529 - protein, 1129 aa, Artificial Sequence [sequence omitted]

SEQ ID NO: 1530 - protein, 487 aa, Artificial Sequence
  source: /note="Description of Artificial Sequence: Synthetic Chimeric Antigen Receptor sequence"
MGTSLLCWMALCLLGADHADAQVQLQQSGPELVKPGASVKISCKASGYAFSSSWMNWVKQRPGKGLEWIGRIYPGDEDTNYSGKFKDKATLTADKSSTTAYMQLSSLTSEDSAVYFCARSLLYGDYLDYWGQGTTLTVSSGGGGSGGGGSGGGGSQIVLTQSPAIMSASPGEKVTMTCSASSSVSYMHWYQQKSGTSPKRWIYDTSKLASGVPDRFSGSGSGTSYFLTINNMEAEDAATYYCQQWNINPLTFGAGTKLELKRSDPTTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1531 - protein, 483 aa, Artificial Sequence
  source: /note="Description of Artificial Sequence: Synthetic Chimeric Antigen Receptor sequence"
MGTSLLCWMALCLLGADHADAQVQLQQSGPELVKPGASVKISCKASGYAFSSSWMNWVKQRPGKGLEWIGRIYPGDEDTNYSGKFKDKATLTADKSSTTAYMQLSSLTSEDSAVYFCARSLLYGDYLDYWGQGTTLTVSSGGGGSGGGGSGGGGSQIVLTQSPAIMSASPGEKVTMTCSASSSVSYMHWYQQKSGTSPKRWIYDTSKLASGVPDRFSGSGSGTSYFLTINNMEAEDAATYYCQQWNINPLTFGAGTKLELKRSDPTTTPAPRPPTPAPTIASQPLSLRPEACRPAAGGAVHTRGLDFACDIYIWAPLAGTCGVLLLSLVITLYCRRDQRLPPDAHKPPGGGSFRTPIQEEQADAHSTLAKIRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1532 - protein, 488 aa, Artificial Sequence
  source: /note="Description of Artificial Sequence: Synthetic Chimeric Antigen Receptor sequence"
MGTSLLCWMALCLLGADHADAQVQLQQSGPELVKPGASVKISCKASGYAFSSSWMNWVKQRPGKGLEWIGRIYPGDEDTNYSGKFKDKATLTADKSSTTAYMQLSSLTSEDSAVYFCARSLLYGDYLDYWGQGTTLTVSSGGGGSGGGGSGGGGSQIVLTQSPAIMSASPGEKVTMTCSASSSVSYMHWYQQKSGTSPKRWIYDTSKLASGVPDRFSGSGSGTSYFLTINNMEAEDAATYYCQQWNINPLTFGAGTKLELKRSDPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1533 - protein, 527 aa, Artificial Sequence
  source: /note="Description of Artificial Sequence: Synthetic Chimeric Antigen Receptor sequence"
MGTSLLCWMALCLLGADHADAQVQLQQSGPELVKPGASVKISCKASGYAFSSSWMNWVKQRPGKGLEWIGRIYPGDEDTNYSGKFKDKATLTADKSSTTAYMQLSSLTSEDSAVYFCARSLLYGDYLDYWGQGTTLTVSSGGGGSGGGGSGGGGSQIVLTQSPAIMSASPGEKVTMTCSASSSVSYMHWYQQKSGTSPKRWIYDTSKLASGVPDRFSGSGSGTSYFLTINNMEAEDAATYYCQQWNINPLTFGAGTKLELKRSDPTTTPAPRPPTPAPTIASQPLSLRPEACRPAAGGAVHTRGLDFACDIFWVLVVVGGVLACYSLLVTVAFIIFWVRSKRSRLLHSDYMNMTPRRPGPTRKHYQPYAPPRDFAAYRSRDQRLPPDAHKPPGGGSFRTPIQEEQADAHSTLAKIRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1534 - protein, 431 aa, Artificial Sequence
  source: /note="Description of Artificial Sequence: Synthetic Chimeric Antigen Receptor sequence"
QVQLQQPGAELVRPGASVKLSCKASGYTFTSYWMNWVKQRPDQGLEWIGRIDPYDSETHYNQKFKDKAILTVDKSSSTAYMQLSSLTSEDSAVYYCARGNWDDYWGQGTTLTVSSGGGGSGGGGSGGGGSDVQITQSPSYLAASPGETITINCRASKSISKDLAWYQEKPGKTNKLLIYSGSTLQSGIPSRFSGSGSGTDFTLTISSLEPEDFAMYYCQQHNKYPYTFGGGTKLEIKGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1535 - protein, 434 aa, Artificial Sequence
  source: /note="Description of Artificial Sequence: Synthetic Chimeric Antigen Receptor sequence"
QVQLQQPGAELVRPGASVKLSCKASGYTFTSYWMNWVKQRPDQGLEWIGRIDPYDSETHYNQKFKDKAILTVDKSSSTAYMQLSSLTSEDSAVYYCARGNWDDYWGQGTTLTVSSGGGGSGGGGSGGGGSDVQITQSPSYLAASPGETITINCRASKSISKDLAWYQEKPGKTNKLLIYSGSTLQSGIPSRFSGSGSGTDFTLTISSLEPEDFAMYYCQQHNKYPYTFGGGTKLEIKGLAVSTISSFFPPGYQIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1536 - protein, 438 aa, Artificial Sequence
  source: /note="Description of Artificial Sequence: Synthetic Chimeric Antigen Receptor sequence"
QIQLVQSGPELKKPGETVKISCKASGYIFTNYGMNWVKQAPGKSFKWMGWINTYTGESTYSADFKGRFAFSLETSASTAYLHINDLKNEDTATYFCARSGGYDPMDYWGQGTSVTVSSGGGGSGGGGSGGGGSDIVLTQSPASLAVSLGQRATISCRASESVDNYGNTFMHWYQQKPGQPPKLLIYRASNLESGIPARFSGSGSRTDFTLTINPVEADDVATYYCQQSNEDPPTFGAGTKLELKGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1537 - protein, 441 aa, Artificial Sequence
  source: /note="Description of Artificial Sequence: Synthetic Chimeric Antigen Receptor sequence"
QIQLVQSGPELKKPGETVKISCKASGYIFTNYGMNWVKQAPGKSFKWMGWINTYTGESTYSADFKGRFAFSLETSASTAYLHINDLKNEDTATYFCARSGGYDPMDYWGQGTSVTVSSGGGGSGGGGSGGGGSDIVLTQSPASLAVSLGQRATISCRASESVDNYGNTFMHWYQQKPGQPPKLLIYRASNLESGIPARFSGSGSRTDFTLTINPVEADDVATYYCQQSNEDPPTFGAGTKLELKGLAVSTISSFFPPGYQIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1538 - protein, 452 aa, Artificial Sequence
  source: /note="Description of Artificial Sequence: Synthetic Chimeric Antigen Receptor sequence"
EVKLVESGGGLVQPGGSLSLSCAASGFTFTDYYMSWVRQPPGKALEWLALIRSKADGYTTEYSASVKGRFTLSRDDSQSILYLQMNALRPEDSATYYCARDAAYYSYYSPEGAMDYWGQGTSVTVSSGGGGSGGGGSGGGGSMADYKDIVMTQSHKFMSTSVGDRVNITCKASQNVDSAVAWYQQKPGQSPKALIYSASYRYSGVPDRFTGRGSGTDFTLTISSVQAEDLAVYYCQQYYSTPWTFGGGTKLEIKRGLAVSTISSFFPPGYQIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1539 - protein, 460 aa, Artificial Sequence
  source: /note="Description of Artificial Sequence: Synthetic Chimeric Antigen Receptor sequence"
QVQLQQPGAELVRPGASVKLSCKASGYTFTSYWMNWVKQRPDQGLEWIGRIDPYDSETHYNQKFKDKAILTVDKSSSTAYMQLSSLTSEDSAVYYCARGNWDDYWGQGTTLTVSSGGGGSGGGGSGGGGSDVQITQSPSYLAASPGETITINCRASKSISKDLAWYQEKPGKTNKLLIYSGSTLQSGIPSRFSGSGSGTDFTLTISSLEPEDFAMYYCQQHNKYPYTFGGGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1540 - protein, 463 aa, Artificial Sequence
  source: /note="Description of Artificial Sequence: Synthetic Chimeric Antigen Receptor sequence"
QVQLQQPGAELVRPGASVKLSCKASGYTFTSYWMNWVKQRPDQGLEWIGRIDPYDSETHYNQKFKDKAILTVDKSSSTAYMQLSSLTSEDSAVYYCARGNWDDYWGQGTTLTVSSGGGGSGGGGSGGGGSDVQITQSPSYLAASPGETITINCRASKSISKDLAWYQEKPGKTNKLLIYSGSTLQSGIPSRFSGSGSGTDFTLTISSLEPEDFAMYYCQQHNKYPYTFGGGTKLEIKTTTPAPRPPTPAPTIASQPLSLRPEACRPAAGGAVHTRGLDFACDIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1541 - protein, 467 aa, Artificial Sequence
  source: /note="Description of Artificial Sequence: Synthetic Chimeric Antigen Receptor sequence"
QIQLVQSGPELKKPGETVKISCKASGYIFTNYGMNWVKQAPGKSFKWMGWINTYTGESTYSADFKGRFAFSLETSASTAYLHINDLKNEDTATYFCARSGGYDPMDYWGQGTSVTVSSGGGGSGGGGSGGGGSDIVLTQSPASLAVSLGQRATISCRASESVDNYGNTFMHWYQQKPGQPPKLLIYRASNLESGIPARFSGSGSRTDFTLTINPVEADDVATYYCQQSNEDPPTFGAGTKLELKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1542 - protein, 470 aa, Artificial Sequence
  source: /note="Description of Artificial Sequence: Synthetic Chimeric Antigen Receptor sequence"
EVQLVESGGGLVQPGRSLRLSCTASGFTFTDYYMSVRQAPGKGLEWVGLIRSKADGYTTEYAASVKGRFTISRDDSQSIAYLQMNSLKTEDTAVYYCARDAAYYSYYSPEGAMDYGQGTLVTVSSGGGGSGGGGSGGGGSDIQMTQSPSSVSASVGDRVTITCKASQNVDSAVAYQQKPGKAPKALIYSASYRYSGVPDRFSGSGSGTDFTLTISSLQPEDLATYYCQQYYSTPWTFGQGTKVEIKRTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1543 - protein, 470 aa, Artificial Sequence
  source: /note="Description of Artificial Sequence: Synthetic Chimeric Antigen Receptor sequence"
EVQLVESGGGLVQPGRSLRLSCTASGFTFTDYYMSVRQAPGKGLEWVGLIRSKADGYTTEYSASVKGRFTISRDDSKSILYLQMNSLKTEDTAVYYCARDAAYYSYYSPEGAMDYGQGTLVTVSSGGGGSGGGGSGGGGSDIQMTQSPSSVSASVGDRVTITCRASQNVDSAVAYQQKPGKAPKALIYSASYRYSGVPSRFSGSGSGTDFTLTISSLQPEDFATYYCQQYYSTPWTFGQGTKVEIKRTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1544 - protein, 470 aa, Artificial Sequence
  source: /note="Description of Artificial Sequence: Synthetic Chimeric Antigen Receptor sequence"
EVQLVESGGGLVQPGRSLRLSCTASGFTFTDYYMSWVRQAPGKGLEWVGLIRSKADGYTTEYSASVKGRFTISRDDSQSIAYLQMNSLKTEDTAVYYCARDAAYYSYYSPEGAMDYGQGTLVTVSSGGGGSGGGGSGGGGSDIQMTQSPSSVSASVGDRVTITCRASQVDSAVAWYQQKPGKAPKALIYSASYRYSGVPSRFSGSGSGTDFTLTISSLQPEDLATYYCQQYYSTPTFGQGTKVEIKRTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1545 - protein, 470 aa, Artificial Sequence
  source: /note="Description of Artificial Sequence: Synthetic Chimeric Antigen Receptor sequence"
MALPVTALLLPLALLLHAARPEVKLVESGGGLVQPGGSLSLSCAASGFTFTDYYMSWVRQPPGKALEWLALIRSKADGYTTEYSASVKGRFTLSRDDSQSILYLQMNALRPEDSATYYCARDAAYYSYYSPEGAMDYWGQGTSVTVSSGGGGSGGGGSGGGGSMADYKDIVMTQSHKFMSTSVGDRVNITCKASQNVDSAVAWYQQKPGQSPKALIYSASYRYSGVPDRFTGRGSGTDFTLTISSVQAEDLAVYYCQQYYSTPWTFGGGTKLEIKRGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1546 - protein, 470 aa, Artificial Sequence
  source: /note="Description of Artificial Sequence: Synthetic Chimeric Antigen Receptor sequence"
MALPVTALLLPLALLLHAARPEVKLVESGGGLVQPGRSLRLSCTASGFTFTDYYMSWVRQAPGKGLEWVGLIRSKADGYTTEYSASVKGRFTISRDDSKSILYLQMNSLKTEDTAVYYCARDAAYYSYYSPEGAMDYWGQGTLVTVSSGGGGSGGGGSGGGGSMADYKDIQMTQSPSSVSASVGDRVTITCRASQNVDSAVAWYQQKPGKAPKALIYSASYRYSGVPSRFSGRGSGTDFTLTISSLQPEDFATYYCQQYYSTPWTFGQGTKVEIKRGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1547 - protein, 470 aa, Artificial Sequence
  source: /note="Description of Artificial Sequence: Synthetic Chimeric Antigen Receptor sequence"
MALPVTALLLPLALLLHAARPEVKLVESGGGLVQPGRSLRLSCTASGFTFTDYYMSWVRQAPGKGLEWVGLIRSKADGYTTEYSASVKGRFTISRDDSKSILYLQMNSLKTEDTAVYYCARDAAYYSYYSPEGAMDYWGQGTLVTVSSGGGGSGGGGSGGGGSMADYKDIQMTQSPSSVSASVGDRVTITCRASQNVDSAVAWYQQKPGKAPKALIYSASYRYSGVPSRFSGSGSGTDFTLTISSLQPEDFATYYCQQYYSTPWTFGQGTKVEIKRGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1548 - protein, 470 aa, Artificial Sequence
  source: /note="Description of Artificial Sequence: Synthetic Chimeric Antigen Receptor sequence"
MALPVTALLLPLALLLHAARPEVKLVESGGGLVQPGRSLRLSCTASGFTFTDYYMSWVRQAPGKGLEWVGLIRSKADGYTTEYSASVKGRFTISRDDSKSILYLQMNSLKTEDTAVYYCARDAAYYSYYSPEGAMDYWGQGTLVTVSSGGGGSGGGGSGGGGSMADYKDIQMTQSPSSVSASVGDRVTITCRASQNVDSAVAWYQQKPGKAPKLLIYSASYGQSGVPSRFSGSGSGTDFTLTISSLQPEDFATYYCQQYYSTPWTFGQGTKVEIKRGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1549 - protein, 470 aa, Artificial Sequence
  source: /note="Description of Artificial Sequence: Synthetic Chimeric Antigen Receptor sequence"
MALPVTALLLPLALLLHAARPEVKLVESGGGLVQPGRSLRLSCTASGFTFTDYYMSWVRQAPGKGLEWVGLIRSKADGYTTEYSASVKGRFTISRDDSKSILYLQMNSLKTEDTAVYYCARDAAYYSYYSPEGAMDYWGQGTLVTVSSGGGGSGGGGSGGGGSMADYKDIQMTQSPSSVSASVGDRVTITCRASQNVDSAVAWYQQKPGKAPKLLIYSASYRQSGVPSRFSGSGSGTDFTLTISSLQPEDFATYYCQQYYSTPWTFGQGTKVEIKRGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1550 - protein, 470 aa, Artificial Sequence
  source: /note="Description of Artificial Sequence: Synthetic Chimeric Antigen Receptor sequence"
MALPVTALLLPLALLLHAARPEVKLVESGGGLVQPGRSLRLSCTASGFTFTDYYMSWVRQAPGKGLEWVGLIRSKADGYTTEYSASVKGRFTISRDDSKSILYLQMNSLKTEDTAVYYCARDAAYYSYYSPEGAMDYWGQGTLVTVSSGGGGSGGGGSGGGGSMADYKDIQMTQSPSSVSASVGDRVTITCRASQNVDSAVAWYQQKPGKAPKLLIYSASYRYSGVPSRFSGSGSGTDFTLTISSLQPEDFATYYCQQYYSTPWTFGQGTKVEIKRGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1551 - protein, 470 aa, Artificial Sequence
  source: /note="Description of Artificial Sequence: Synthetic Chimeric Antigen Receptor sequence"
MALPVTALLLPLALLLHAARPEVKLVESGGGLVQPGRSLRLSCTASGFTFTDYYMSWVRQAPGKGLEWVGLIRSKADGYTTEYSASVKGRFTISRDDSKSILYLQMNSLKTEDTAVYYCARDAAYYSYYSPEGAMDYWGQGTLVTVSSGGGGSGGGGSGGGGSMADYKDIVMTQSPSSVSASVGDRVTITCRASQNVDSAVAWYQQKPGKAPKALIYSASYRYSGVPSRFSGRGSGTDFTLTISSLQPEDFATYYCQQYYSTPWTFGQGTKVEIKRGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1552 - protein, 470 aa, Artificial Sequence
  source: /note="Description of Artificial Sequence: Synthetic Chimeric Antigen Receptor sequence"
MALPVTALLLPLALLLHAARPEVQLVESGGGLVQPGRSLRLSCTASGFTFTDYYMSWVRQAPGKGLEWVGFIRSKADGYTTEYAASVKGRFTISRDDSKSIAYLQMNSLKTEDTAVYYCARDAAYYSYYSPEGAMDYWGQGTLVTVSSGGGGSGGGGSGGGGSMADYKDIQMTQSPSSVSASVGDRVTITCRASQNVDSAVAWYQQKPGKAPKALIYSASYRYSGVPSRFSGRGSGTDFTLTISSLQPEDFATYYCQQYYSTPWTFGQGTKVEIKRGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1553 - protein, 470 aa, Artificial Sequence
  source: /note="Description of Artificial Sequence: Synthetic Chimeric Antigen Receptor sequence"
MALPVTALLLPLALLLHAARPEVQLVESGGGLVQPGRSLRLSCTASGFTFTDYYMSWVRQAPGKGLEWVGFIRSKADGYTTEYAASVKGRFTISRDDSKSIAYLQMNSLKTEDTAVYYCARDAAYYSYYSPEGAMDYWGQGTLVTVSSGGGGSGGGGSGGGGSMADYKDIQMTQSPSSVSASVGDRVTITCRASQNVDSAVAWYQQKPGKAPKALIYSASYRYSGVPSRFSGSGSGTDFTLTISSLQPEDFATYYCQQYYSTPWTFGQGTKVEIKRGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1554 - protein, 470 aa, Artificial Sequence
  source: /note="Description of Artificial Sequence: Synthetic Chimeric Antigen Receptor sequence"
MALPVTALLLPLALLLHAARPEVQLVESGGGLVQPGRSLRLSCTASGFTFTDYYMSWVRQAPGKGLEWVGFIRSKADGYTTEYAASVKGRFTISRDDSKSIAYLQMNSLKTEDTAVYYCARDAAYYSYYSPEGAMDYWGQGTLVTVSSGGGGSGGGGSGGGGSMADYKDIQMTQSPSSVSASVGDRVTITCRASQNVDSAVAWYQQKPGKAPKLLIYSASYGQSGVPSRFSGSGSGTDFTLTISSLQPEDFATYYCQQYYSTPWTFGQGTKVEIKRGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1555 - protein, 470 aa, Artificial Sequence
  source: /note="Description of Artificial Sequence: Synthetic Chimeric Antigen Receptor sequence"
MALPVTALLLPLALLLHAARPEVQLVESGGGLVQPGRSLRLSCTASGFTFTDYYMSWVRQAPGKGLEWVGFIRSKADGYTTEYAASVKGRFTISRDDSKSIAYLQMNSLKTEDTAVYYCARDAAYYSYYSPEGAMDYWGQGTLVTVSSGGGGSGGGGSGGGGSMADYKDIQMTQSPSSVSASVGDRVTITCRASQNVDSAVAWYQQKPGKAPKLLIYSASYRQSGVPSRFSGSGSGTDFTLTISSLQPEDFATYYCQQYYSTPWTFGQGTKVEIKRGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1556 - protein, 470 aa, Artificial Sequence
  source: /note="Description of Artificial Sequence: Synthetic Chimeric Antigen Receptor sequence"
MALPVTALLLPLALLLHAARPEVQLVESGGGLVQPGRSLRLSCTASGFTFTDYYMSWVRQAPGKGLEWVGFIRSKADGYTTEYAASVKGRFTISRDDSKSIAYLQMNSLKTEDTAVYYCARDAAYYSYYSPEGAMDYWGQGTLVTVSSGGGGSGGGGSGGGGSMADYKDIQMTQSPSSVSASVGDRVTITCRASQNVDSAVAWYQQKPGKAPKLLIYSASYRYSGVPSRFSGSGSGTDFTLTISSLQPEDFATYYCQQYYSTPWTFGQGTKVEIKRGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1557 - protein, 470 aa, Artificial Sequence
  source: /note="Description of Artificial Sequence: Synthetic Chimeric Antigen Receptor sequence"
MALPVTALLLPLALLLHAARPEVQLVESGGGLVQPGRSLRLSCTASGFTFTDYYMSWVRQAPGKGLEWVGFIRSKADGYTTEYAASVKGRFTISRDDSKSIAYLQMNSLKTEDTAVYYCARDAAYYSYYSPEGAMDYWGQGTLVTVSSGGGGSGGGGSGGGGSMADYKDIVMTQSPSSVSASVGDRVTITCRASQNVDSAVAWYQQKPGKAPKALIYSASYRYSGVPSRFSGRGSGTDFTLTISSLQPEDFATYYCQQYYSTPWTFGQGTKVEIKRGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1558 - protein, 470 aa, Artificial Sequence
  source: /note="Description of Artificial Sequence: Synthetic Chimeric Antigen Receptor sequence"
MALPVTALLLPLALLLHAARPEVQLVESGGGLVQPGRSLRLSCTASGFTFTDYYMSWVRQAPGKGLEWVGFIRSKADGYTTEYAASVKGRFTISRDDSKSIAYLQMNSLKTEDTAVYYCTRDAAYYSYYSPEGAMDYWGQGTLVTVSSGGGGSGGGGSGGGGSMADYKDIQMTQSPSSVSASVGDRVTITCRASQNVDSAVAWYQQKPGKAPKALIYSASYRYSGVPSRFSGRGSGTDFTLTISSLQPEDFATYYCQQYYSTPWTFGQGTKVEIKRGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1559 - protein, 470 aa, Artificial Sequence
  source: /note="Description of Artificial Sequence: Synthetic Chimeric Antigen Receptor sequence"
MALPVTALLLPLALLLHAARPEVQLVESGGGLVQPGRSLRLSCTASGFTFTDYYMSWVRQAPGKGLEWVGFIRSKADGYTTEYAASVKGRFTISRDDSKSIAYLQMNSLKTEDTAVYYCTRDAAYYSYYSPEGAMDYWGQGTLVTVSSGGGGSGGGGSGGGGSMADYKDIQMTQSPSSVSASVGDRVTITCRASQNVDSAVAWYQQKPGKAPKALIYSASYRYSGVPSRFSGSGSGTDFTLTISSLQPEDFATYYCQQYYSTPWTFGQGTKVEIKRGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1560 - protein, 470 aa, Artificial Sequence
  source: /note="Description of Artificial Sequence: Synthetic Chimeric Antigen Receptor sequence"
MALPVTALLLPLALLLHAARPEVQLVESGGGLVQPGRSLRLSCTASGFTFTDYYMSWVRQAPGKGLEWVGFIRSKADGYTTEYAASVKGRFTISRDDSKSIAYLQMNSLKTEDTAVYYCTRDAAYYSYYSPEGAMDYWGQGTLVTVSSGGGGSGGGGSGGGGSMADYKDIQMTQSPSSVSASVGDRVTITCRASQNVDSAVAWYQQKPGKAPKLLIYSASYGQSGVPSRFSGSGSGTDFTLTISSLQPEDFATYYCQQYYSTPWTFGQGTKVEIKRGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1561 - protein, 470 aa, Artificial Sequence
  source: /note="Description of Artificial Sequence: Synthetic Chimeric Antigen Receptor sequence"
MALPVTALLLPLALLLHAARPEVQLVESGGGLVQPGRSLRLSCTASGFTFTDYYMSWVRQAPGKGLEWVGFIRSKADGYTTEYAASVKGRFTISRDDSKSIAYLQMNSLKTEDTAVYYCTRDAAYYSYYSPEGAMDYWGQGTLVTVSSGGGGSGGGGSGGGGSMADYKDIQMTQSPSSVSASVGDRVTITCRASQNVDSAVAWYQQKPGKAPKLLIYSASYRQSGVPSRFSGSGSGTDFTLTISSLQPEDFATYYCQQYYSTPWTFGQGTKVEIKRGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1562 - protein, 470 aa, Artificial Sequence
  source: /note="Description of Artificial Sequence: Synthetic Chimeric Antigen Receptor sequence"
MALPVTALLLPLALLLHAARPEVQLVESGGGLVQPGRSLRLSCTASGFTFTDYYMSWVRQAPGKGLEWVGFIRSKADGYTTEYAASVKGRFTISRDDSKSIAYLQMNSLKTEDTAVYYCTRDAAYYSYYSPEGAMDYWGQGTLVTVSSGGGGSGGGGSGGGGSMADYKDIQMTQSPSSVSASVGDRVTITCRASQNVDSAVAWYQQKPGKAPKLLIYSASYRYSGVPSRFSGSGSGTDFTLTISSLQPEDFATYYCQQYYSTPWTFGQGTKVEIKRGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1563 - protein, 470 aa, Artificial Sequence
  source: /note="Description of Artificial Sequence: Synthetic Chimeric Antigen Receptor sequence"
MALPVTALLLPLALLLHAARPEVQLVESGGGLVQPGRSLRLSCTASGFTFTDYYMSWVRQAPGKGLEWVGFIRSKADGYTTEYAASVKGRFTISRDDSKSIAYLQMNSLKTEDTAVYYCTRDAAYYSYYSPEGAMDYWGQGTLVTVSSGGGGSGGGGSGGGGSMADYKDIVMTQSPSSVSASVGDRVTITCRASQNVDSAVAWYQQKPGKAPKALIYSASYRYSGVPSRFSGRGSGTDFTLTISSLQPEDFATYYCQQYYSTPWTFGQGTKVEIKRGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1564 - protein, 470 aa, Artificial Sequence
  source: /note="Description of Artificial Sequence: Synthetic Chimeric Antigen Receptor sequence"
MALPVTALLLPLALLLHAARPEVQLVESGGGLVQPGRSLRLSCTASGFTFTDYYMSWVRQAPGKGLEWVGFIRSKADGYTTEYSASVKGRFTISRDDSKSIAYLQMNSLKTEDTAVYYCARDAAYYSYYSPEGAMDYWGQGTLVTVSSGGGGSGGGGSGGGGSMADYKDIQMTQSPSSVSASVGDRVTITCRASQNVDSAVAWYQQKPGKAPKALIYSASYRYSGVPSRFSGRGSGTDFTLTISSLQPEDFATYYCQQYYSTPWTFGQGTKVEIKRGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1565 - protein, 470 aa, Artificial Sequence
  source: /note="Description of Artificial Sequence: Synthetic Chimeric Antigen Receptor sequence"
MALPVTALLLPLALLLHAARPEVQLVESGGGLVQPGRSLRLSCTASGFTFTDYYMSWVRQAPGKGLEWVGFIRSKADGYTTEYSASVKGRFTISRDDSKSIAYLQMNSLKTEDTAVYYCARDAAYYSYYSPEGAMDYWGQGTLVTVSSGGGGSGGGGSGGGGSMADYKDIQMTQSPSSVSASVGDRVTITCRASQNVDSAVAWYQQKPGKAPKALIYSASYRYSGVPSRFSGSGSGTDFTLTISSLQPEDFATYYCQQYYSTPWTFGQGTKVEIKRGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1566 - protein, 470 aa, Artificial Sequence
  source: /note="Description of Artificial Sequence: Synthetic Chimeric Antigen Receptor sequence"
MALPVTALLLPLALLLHAARPEVQLVESGGGLVQPGRSLRLSCTASGFTFTDYYMSWVRQAPGKGLEWVGFIRSKADGYTTEYSASVKGRFTISRDDSKSIAYLQMNSLKTEDTAVYYCARDAAYYSYYSPEGAMDYWGQGTLVTVSSGGGGSGGGGSGGGGSMADYKDIQMTQSPSSVSASVGDRVTITCRASQNVDSAVAWYQQKPGKAPKLLIYSASYGQSGVPSRFSGSGSGTDFTLTISSLQPEDFATYYCQQYYSTPWTFGQGTKVEIKRGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1567 - protein, 470 aa, Artificial Sequence
  source: /note="Description of Artificial Sequence: Synthetic Chimeric Antigen Receptor sequence"
MALPVTALLLPLALLLHAARPEVQLVESGGGLVQPGRSLRLSCTASGFTFTDYYMSWVRQAPGKGLEWVGFIRSKADGYTTEYSASVKGRFTISRDDSKSIAYLQMNSLKTEDTAVYYCARDAAYYSYYSPEGAMDYWGQGTLVTVSSGGGGSGGGGSGGGGSMADYKDIQMTQSPSSVSASVGDRVTITCRASQNVDSAVAWYQQKPGKAPKLLIYSASYRQSGVPSRFSGSGSGTDFTLTISSLQPEDFATYYCQQYYSTPWTFGQGTKVEIKRGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1568 - protein, 470 aa, Artificial Sequence
  source: /note="Description of Artificial Sequence: Synthetic Chimeric Antigen Receptor sequence"
MALPVTALLLPLALLLHAARPEVQLVESGGGLVQPGRSLRLSCTASGFTFTDYYMSWVRQAPGKGLEWVGFIRSKADGYTTEYSASVKGRFTISRDDSKSIAYLQMNSLKTEDTAVYYCARDAAYYSYYSPEGAMDYWGQGTLVTVSSGGGGSGGGGSGGGGSMADYKDIQMTQSPSSVSASVGDRVTITCRASQNVDSAVAWYQQKPGKAPKLLIYSASYRYSGVPSRFSGSGSGTDFTLTISSLQPEDFATYYCQQYYSTPWTFGQGTKVEIKRGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1569 - protein, 470 aa, Artificial Sequence
  source: /note="Description of Artificial Sequence: Synthetic Chimeric Antigen Receptor sequence"
MALPVTALLLPLALLLHAARPEVQLVESGGGLVQPGRSLRLSCTASGFTFTDYYMSWVRQAPGKGLEWVGFIRSKADGYTTEYSASVKGRFTISRDDSKSIAYLQMNSLKTEDTAVYYCARDAAYYSYYSPEGAMDYWGQGTLVTVSSGGGGSGGGGSGGGGSMADYKDIVMTQSPSSVSASVGDRVTITCRASQNVDSAVAWYQQKPGKAPKALIYSASYRYSGVPSRFSGRGSGTDFTLTISSLQPEDFATYYCQQYYSTPWTFGQGTKVEIKRGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1570 - protein, 470 aa, Artificial Sequence
  source: /note="Description of Artificial Sequence: Synthetic Chimeric Antigen Receptor sequence"
MALPVTALLLPLALLLHAARPEVQLVESGGGLVQPGRSLRLSCTASGFTFTDYYMSWVRQAPGKGLEWVGLIRSKADGYTTEYAASVKGRFTISRDDSKSIAYLQMNSLKTEDTAVYYCARDAAYYSYYSPEGAMDYWGQGTLVTVSSGGGGSGGGGSGGGGSMADYKDIQMTQSPSSVSASVGDRVTITCRASQNVDSAVAWYQQKPGKAPKALIYSASYRYSGVPSRFSGRGSGTDFTLTISSLQPEDFATYYCQQYYSTPWTFGQGTKVEIKRGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1571 - protein, 470 aa, Artificial Sequence
  source: /note="Description of Artificial Sequence: Synthetic Chimeric Antigen Receptor sequence"
MALPVTALLLPLALLLHAARPEVQLVESGGGLVQPGRSLRLSCTASGFTFTDYYMSWVRQAPGKGLEWVGLIRSKADGYTTEYAASVKGRFTISRDDSKSIAYLQMNSLKTEDTAVYYCARDAAYYSYYSPEGAMDYWGQGTLVTVSSGGGGSGGGGSGGGGSMADYKDIQMTQSPSSVSASVGDRVTITCRASQNVDSAVAWYQQKPGKAPKALIYSASYRYSGVPSRFSGSGSGTDFTLTISSLQPEDFATYYCQQYYSTPWTFGQGTKVEIKRGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1572 - protein, 470 aa, Artificial Sequence
  source: /note="Description of Artificial Sequence: Synthetic Chimeric Antigen Receptor sequence"
MALPVTALLLPLALLLHAARPEVQLVESGGGLVQPGRSLRLSCTASGFTFTDYYMSWVRQAPGKGLEWVGLIRSKADGYTTEYAASVKGRFTISRDDSKSIAYLQMNSLKTEDTAVYYCARDAAYYSYYSPEGAMDYWGQGTLVTVSSGGGGSGGGGSGGGGSMADYKDIQMTQSPSSVSASVGDRVTITCRASQNVDSAVAWYQQKPGKAPKLLIYSASYGQSGVPSRFSGSGSGTDFTLTISSLQPEDFATYYCQQYYSTPWTFGQGTKVEIKRGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1573 - protein, 470 aa, Artificial Sequence
  source: /note="Description of Artificial Sequence: Synthetic Chimeric Antigen Receptor sequence"
MALPVTALLLPLALLLHAARPEVQLVESGGGLVQPGRSLRLSCTASGFTFTDYYMSWVRQAPGKGLEWVGLIRSKADGYTTEYAASVKGRFTISRDDSKSIAYLQMNSLKTEDTAVYYCARDAAYYSYYSPEGAMDYWGQGTLVTVSSGGGGSGGGGSGGGGSMADYKDIQMTQSPSSVSASVGDRVTITCRASQNVDSAVAWYQQKPGKAPKLLIYSASYRQSGVPSRFSGSGSGTDFTLTISSLQPEDFATYYCQQYYSTPWTFGQGTKVEIKRGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1574 - protein, 470 aa, Artificial Sequence
  source: /note="Description of Artificial Sequence: Synthetic Chimeric Antigen Receptor sequence"
MALPVTALLLPLALLLHAARPEVQLVESGGGLVQPGRSLRLSCTASGFTFTDYYMSWVRQAPGKGLEWVGLIRSKADGYTTEYAASVKGRFTISRDDSKSIAYLQMNSLKTEDTAVYYCARDAAYYSYYSPEGAMDYWGQGTLVTVSSGGGGSGGGGSGGGGSMADYKDIQMTQSPSSVSASVGDRVTITCRASQNVDSAVAWYQQKPGKAPKLLIYSASYRYSGVPSRFSGSGSGTDFTLTISSLQPEDFATYYCQQYYSTPWTFGQGTKVEIKRGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1575 - protein, 470 aa, Artificial Sequence
  source: /note="Description of Artificial Sequence: Synthetic Chimeric Antigen Receptor sequence"
MALPVTALLLPLALLLHAARPEVQLVESGGGLVQPGRSLRLSCTASGFTFTDYYMSWVRQAPGKGLEWVGLIRSKADGYTTEYAASVKGRFTISRDDSKSIAYLQMNSLKTEDTAVYYCARDAAYYSYYSPEGAMDYWGQGTLVTVSSGGGGSGGGGSGGGGSMADYKDIVMTQSPSSVSASVGDRVTITCRASQNVDSAVAWYQQKPGKAPKALIYSASYRYSGVPSRFSGRGSGTDFTLTISSLQPEDFATYYCQQYYSTPWTFGQGTKVEIKRGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1576 - protein, 470 aa, Artificial Sequence
  source: /note="Description of Artificial Sequence: Synthetic Chimeric Antigen Receptor sequence"
MALPVTALLLPLALLLHAARPEVQLVESGGGLVQPGRSLRLSCTASGFTFTDYYMSWVRQAPGKGLEWVGLIRSKADGYTTEYSASVKGRFTISRDDSKSIAYLQMNSLKTEDTAVYYCARDAAYYSYYSPEGAMDYWGQGTLVTVSSGGGGSGGGGSGGGGSMADYKDIQMTQSPSSVSASVGDRVTITCRASQNVDSAVAWYQQKPGKAPKALIYSASYRYSGVPSRFSGRGSGTDFTLTISSLQPEDFATYYCQQYYSTPWTFGQGTKVEIKRGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1577 - protein, 470 aa, Artificial Sequence
  source: /note="Description of Artificial Sequence: Synthetic Chimeric Antigen Receptor sequence"
MALPVTALLLPLALLLHAARPEVQLVESGGGLVQPGRSLRLSCTASGFTFTDYYMSWVRQAPGKGLEWVGLIRSKADGYTTEYSASVKGRFTISRDDSKSIAYLQMNSLKTEDTAVYYCARDAAYYSYYSPEGAMDYWGQGTLVTVSSGGGGSGGGGSGGGGSMADYKDIQMTQSPSSVSASVGDRVTITCRASQNVDSAVAWYQQKPGKAPKALIYSASYRYSGVPSRFSGSGSGTDFTLTISSLQPEDFATYYCQQYYSTPWTFGQGTKVEIKRGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1578 - protein, 470 aa, Artificial Sequence
  source: /note="Description of Artificial Sequence: Synthetic Chimeric Antigen Receptor sequence"
MALPVTALLLPLALLLHAARPEVQLVESGGGLVQPGRSLRLSCTASGFTFTDYYMSWVRQAPGKGLEWVGLIRSKADGYTTEYSASVKGRFTISRDDSKSIAYLQMNSLKTEDTAVYYCARDAAYYSYYSPEGAMDYWGQGTLVTVSSGGGGSGGGGSGGGGSMADYKDIQMTQSPSSVSASVGDRVTITCRASQNVDSAVAWYQQKPGKAPKLLIYSASYGQSGVPSRFSGSGSGTDFTLTISSLQPEDFATYYCQQYYSTPWTFGQGTKVEIKRGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1579 - protein, 470 aa, Artificial Sequence
  source: /note="Description of Artificial Sequence: Synthetic Chimeric Antigen Receptor sequence"
MALPVTALLLPLALLLHAARPEVQLVESGGGLVQPGRSLRLSCTASGFTFTDYYMSWVRQAPGKGLEWVGLIRSKADGYTTEYSASVKGRFTISRDDSKSIAYLQMNSLKTEDTAVYYCARDAAYYSYYSPEGAMDYWGQGTLVTVSSGGGGSGGGGSGGGGSMADYKDIQMTQSPSSVSASVGDRVTITCRASQNVDSAVAWYQQKPGKAPKLLIYSASYRQSGVPSRFSGSGSGTDFTLTISSLQPEDFATYYCQQYYSTPWTFGQGTKVEIKRGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1580 - protein, 470 aa, Artificial Sequence
  source: /note="Description of Artificial Sequence: Synthetic Chimeric Antigen Receptor sequence"
MALPVTALLLPLALLLHAARPEVQLVESGGGLVQPGRSLRLSCTASGFTFTDYYMSWVRQAPGKGLEWVGLIRSKADGYTTEYSASVKGRFTISRDDSKSIAYLQMNSLKTEDTAVYYCARDAAYYSYYSPEGAMDYWGQGTLVTVSSGGGGSGGGGSGGGGSMADYKDIQMTQSPSSVSASVGDRVTITCRASQNVDSAVAWYQQKPGKAPKLLIYSASYRYSGVPSRFSGSGSGTDFTLTISSLQPEDFATYYCQQYYSTPWTFGQGTKVEIKRGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1581 - protein, 470 aa, Artificial Sequence
  source: /note="Description of Artificial Sequence: Synthetic Chimeric Antigen Receptor sequence"
MALPVTALLLPLALLLHAARPEVQLVESGGGLVQPGRSLRLSCTASGFTFTDYYMSWVRQAPGKGLEWVGLIRSKADGYTTEYSASVKGRFTISRDDSKSIAYLQMNSLKTEDTAVYYCARDAAYYSYYSPEGAMDYWGQGTLVTVSSGGGGSGGGGSGGGGSMADYKDIVMTQSPSSVSASVGDRVTITCRASQNVDSAVAWYQQKPGKAPKALIYSASYRYSGVPSRFSGRGSGTDFTLTISSLQPEDFATYYCQQYYSTPWTFGQGTKVEIKRGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1582 - protein, 470 aa, Artificial Sequence
  source: /note="Description of Artificial Sequence: Synthetic Chimeric Antigen Receptor sequence"
MALPVTALLLPLALLLHAARPEVQLVESGGGLVQPGRSLRLSCTASGFTFTDYYMSWVRQAPGKGLEWVGLIRSKADGYTTEYSASVKGRFTISRDDSKSILYLQMNSLKTEDTAVYYCARDAAYYSYYSPEGAMDYWGQGTLVTVSSGGGGSGGGGSGGGGSMADYKDIQMTQSPSSVSASVGDRVTITCRASQNVDSAVAWYQQKPGKAPKALIYSASYRYSGVPSRFSGRGSGTDFTLTISSLQPEDFATYYCQQYYSTPWTFGQGTKVEIKRGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1583 - protein, 470 aa, Artificial Sequence
  source: /note="Description of Artificial Sequence: Synthetic Chimeric Antigen Receptor sequence"
MALPVTALLLPLALLLHAARPEVQLVESGGGLVQPGRSLRLSCTASGFTFTDYYMSWVRQAPGKGLEWVGLIRSKADGYTTEYSASVKGRFTISRDDSKSILYLQMNSLKTEDTAVYYCARDAAYYSYYSPEGAMDYWGQGTLVTVSSGGGGSGGGGSGGGGSMADYKDIQMTQSPSSVSASVGDRVTITCRASQNVDSAVAWYQQKPGKAPKALIYSASYRYSGVPSRFSGSGSGTDFTLTISSLQPEDFATYYCQQYYSTPWTFGQGTKVEIKRGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1584 - protein, 470 aa, Artificial Sequence
  source: /note="Description of Artificial Sequence: Synthetic Chimeric Antigen Receptor sequence"
MALPVTALLLPLALLLHAARPEVQLVESGGGLVQPGRSLRLSCTASGFTFTDYYMSWVRQAPGKGLEWVGLIRSKADGYTTEYSASVKGRFTISRDDSKSILYLQMNSLKTEDTAVYYCARDAAYYSYYSPEGAMDYWGQGTLVTVSSGGGGSGGGGSGGGGSMADYKDIQMTQSPSSVSASVGDRVTITCRASQNVDSAVAWYQQKPGKAPKLLIYSASYGQSGVPSRFSGSGSGTDFTLTISSLQPEDFATYYCQQYYSTPWTFGQGTKVEIKRGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1585 - protein, 470 aa, Artificial Sequence
  source: /note="Description of Artificial Sequence: Synthetic Chimeric Antigen Receptor sequence"
MALPVTALLLPLALLLHAARPEVQLVESGGGLVQPGRSLRLSCTASGFTFTDYYMSWVRQAPGKGLEWVGLIRSKADGYTTEYSASVKGRFTISRDDSKSILYLQMNSLKTEDTAVYYCARDAAYYSYYSPEGAMDYWGQGTLVTVSSGGGGSGGGGSGGGGSMADYKDIQMTQSPSSVSASVGDRVTITCRASQNVDSAVAWYQQKPGKAPKLLIYSASYRQSGVPSRFSGSGSGTDFTLTISSLQPEDFATYYCQQYYSTPWTFGQGTKVEIKRGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1586 - protein, 470 aa, Artificial Sequence
  source: /note="Description of Artificial Sequence: Synthetic Chimeric Antigen Receptor sequence"
MALPVTALLLPLALLLHAARPEVQLVESGGGLVQPGRSLRLSCTASGFTFTDYYMSWVRQAPGKGLEWVGLIRSKADGYTTEYSASVKGRFTISRDDSKSILYLQMNSLKTEDTAVYYCARDAAYYSYYSPEGAMDYWGQGTLVTVSSGGGGSGGGGSGGGGSMADYKDIQMTQSPSSVSASVGDRVTITCRASQNVDSAVAWYQQKPGKAPKLLIYSASYRYSGVPSRFSGSGSGTDFTLTISSLQPEDFATYYCQQYYSTPWTFGQGTKVEIKRGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1587 - protein, 470 aa, Artificial Sequence
  source: /note="Description of Artificial Sequence: Synthetic Chimeric Antigen Receptor sequence"
MALPVTALLLPLALLLHAARPEVQLVESGGGLVQPGRSLRLSCTASGFTFTDYYMSWVRQAPGKGLEWVGLIRSKADGYTTEYSASVKGRFTISRDDSKSILYLQMNSLKTEDTAVYYCARDAAYYSYYSPEGAMDYWGQGTLVTVSSGGGGSGGGGSGGGGSMADYKDIVMTQSPSSVSASVGDRVTITCRASQNVDSAVAWYQQKPGKAPKALIYSASYRYSGVPSRFSGRGSGTDFTLTISSLQPEDFATYYCQQYYSTPWTFGQGTKVEIKRGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1588 - protein, 470 aa, Artificial Sequence
  source: /note="Description of Artificial Sequence: Synthetic Chimeric Antigen Receptor sequence"
QIQLVQSGPELKKPGETVKISCKASGYIFTNYGMNWVKQAPGKSFKWMGWINTYTGESTYSADFKGRFAFSLETSASTAYLHINDLKNEDTATYFCARSGGYDPMDYWGQGTSVTVSSGGGGSGGGGSGGGGSDIVLTQSPASLAVSLGQRATISCRASESVDNYGNTFMHWYQQKPGQPPKLLIYRASNLESGIPARFSGSGSRTDFTLTINPVEADDVATYYCQQSNEDPPTFGAGTKLELKTTTPAPRPPTPAPTIASQPLSLRPEACRPAAGGAVHTRGLDFACDIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1589 - protein, 470 aa, Artificial Sequence
  source: /note="Description of Artificial Sequence: Synthetic Chimeric Antigen Receptor sequence"
VQLQESGPGLVKPSQSLSLTCSVTDYSITSGYYWNWIRQFPGNKLEWMGYISYDGSNNYNPSLKNRISITRDTSKNQFFLKLSSVTTEDTATYYCSRGEGFYFDSWGQGTTLTVSSARSGGGGSGGGGSGGGGSDIMMSQSPSSLAVSVGEKFTMTCKSSQSLFFGSTQKNYLAWYQQKPGQSPKLLIYWASTRESGVPDRFTGSGSGTDFTLAISSVMPEDLAVYYCQQYYNYPWTFGGGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1590 - protein, 471 aa, Artificial Sequence
  source: /note="Description of Artificial Sequence: Synthetic Chimeric Antigen Receptor sequence"
EVQLVESGGGLVQPGRSLRLSCTASGFTFTDYYMSWVRQAPGKGLEWVGLIRSKADGYTTEYAASVKGRFTISRDDSQSIAYLQMNSLKTEDTAVYYCARDAAYYSYYSPEGAMDYGQGTLVTVSSGGGGSGGGGSGGGGSDIQMTQSPSSVSASVGDRVTITCRASQNVDSAVAYQQKPGKAPKALIYSASYRYSGVPSRFSGSGSGTDFTLTISSLQPEDFATYYCQQYYSTPWTFGQGTKVEIKRTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1591 - protein, 471 aa, Artificial Sequence
  source: /note="Description of Artificial Sequence: Synthetic Chimeric Antigen Receptor sequence"
EVQLVESGGGLVQPGRSLRLSCTASGFTFTDYYMSWVRQAPGKGLEWVGLIRSKADGYTTEYAASVKGRFTISRDDSQSIAYLQMNSLKTEDTAVYYCARDAAYYSYYSPEGAMDYGQGTLVTVSSGGGGSGGGGSGGGGSDIVMTQSPSSVSASVGDRVTITCRASQNVDSAVAYQQKPGKAPKALIYSASYRYSGVPSRFSGRGSGTDFTLTISSLQPEDFATYYCQQYYSTPWTFGQGTKVEIKRTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1592 - protein, 471 aa, Artificial Sequence
  source: /note="Description of Artificial Sequence: Synthetic Chimeric Antigen Receptor sequence"
EVQLVESGGGLVQPGRSLRLSCTASGFTFTDYYMSWVRQAPGKGLEWVGLIRSKADGYTTEYSASVKGRFTISRDDSQSIAYLQMNSLKTEDTAVYYCARDAAYYSYYSPEGAMDYGQGTLVTVSSGGGGSGGGGSGGGGSDIQMTQSPSSVSASVGDRVTITCKASQNVDSAVAYQQKPGKAPKLLIYSASYRYSGVPSRFSGSGSGTDFTLTISSLQPEDFATYYCQQYYSTPWTFGQGTKVEIKRTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1593 - protein, 471 aa, Artificial Sequence
  source: /note="Description of Artificial Sequence: Synthetic Chimeric Antigen Receptor sequence"
EVQLVESGGGLVQPGRSLRLSCTASGFTFTDYYMSWVRQAPGKGLEWVGLIRSKADGYTTEYSASVKGRFTISRDDSQSIAYLQMNSLKTEDTAVYYCARDAAYYSYYSPEGAMDYGQGTLVTVSSGGGGSGGGGSGGGGSDIQMTQSPSSVSASVGDRVTITCRASQVDSAVAWYQQKPGKAPKALIYSASYRYSGVPSRFSGSGSGTDFTLTISSLQPEDFATYYCGQYYSTPWTFGQGTKVEIKRTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1594 - protein, 473 aa, Artificial Sequence
  source: /note="Description of Artificial Sequence: Synthetic Chimeric Antigen Receptor sequence"
EVQLVESGGGLVQPGRSLRLSCTASGFTFTDYYMSWVRQAPGKGLEWVGLIRSKADGYTTEYSASVKGRFTISRDDSKSILYLQMNSLKTEDTAVYYCARDAAYYSYYSPEGAMDYWGQGTLVTVSSGGGGSGGGGSGGGGSDIVMTQSPSSVSASVGDRVTITCRASQNVDSAVAWYQQKPGKAPKALIYSASYRYSGVPSRFSGRGSGTDFTLTISSLQPEDFATYYCQQYYSTPWTFGQGTKVEIKRTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1595 - protein, 478 aa, Artificial Sequence
  source: /note="Description of Artificial Sequence: Synthetic Chimeric Antigen Receptor sequence"
EVKLVESGGGLVQPGGSLSLSCAASGFTFTDYYMSWVRQPPGKALEWLALIRSKADGYTTEYSASVKGRFTLSRDDSQSILYLQMNALRPEDSATYYCARDAAYYSYYSPEGAMDYWGQGTSVTVSSGGGGSGGGGSGGGGSMADYKDIVMTQSHKFMSTSVGDRVNITCKASQNVDSAVAWYQQKPGQSPKALIYSASYRYSGVPDRFTGRGSGTDFTLTISSVQAEDLAVYYCQQYYSTPWTFGGGTKLEIKRTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1596 - protein, 481 aa, Artificial Sequence
  source: /note="Description of Artificial Sequence: Synthetic Chimeric Antigen Receptor sequence"
EVKLVESGGGLVQPGGSLSLSCAASGFTFTDYYMSWVRQPPGKALEWLALIRSKADGYTTEYSASVKGRFTLSRDDSQSILYLQMNALRPEDSATYYCARDAAYYSYYSPEGAMDYWGQGTSVTVSSGGGGSGGGGSGGGGSMADYKDIVMTQSHKFMSTSVGDRVNITCKASQNVDSAVAWYQQKPGQSPKALIYSASYRYSGVPDRFTGRGSGTDFTLTISSVQAEDLAVYYCQQYYSTPWTFGGGTKLEIKRTTTPAPRPPTPAPTIASQPLSLRPEACRPAAGGAVHTRGLDFACDIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1597 - protein, 484 aa, Artificial Sequence
  source: /note="Description of Artificial Sequence: Synthetic Chimeric Antigen Receptor sequence"
MGWSWIFLFLVSGTGGVLSEVQLQQSGPELVKPGASVKMSCKASGYTFTDYYMKWVKQSHGKSLEWIGDIIPSNGATFYNQKFKGKATLTVDRSSSTAYMHLNSLTSEDSAVYYCTRSHLLRASWFAYWGQGTLVTVSAASGGGGSGGGGSGGGGSMESQTQVLMSLLFWVSGTCGDFVMTQSPSSLTVTAGEKVTMSCKSSQSLLNSGNQKNYLTWYLQKPGQPPKLLIYWASTRESGVPDRFTGSGSGTDFTLTISSVQAEDLAVYYCQNDYSYPYTFGGGTKLEIKRGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1598 - protein, 486 aa, Artificial Sequence
  source: /note="Description of Artificial Sequence: Synthetic Chimeric Antigen Receptor sequence"
MALPVTALLLPLALLLHAARPDVQLTQSPSFLSASVGDRVTITCRASKSISKDLAWYQQKPGKAPKLLIYSGSTLQSGVPSRFSGSGSGTEFTLTISSLQPEDFATYYCQQHNKYPYTFGGGTKVEIKGGGGSGGGGSGGGGSGGGGSEVQLVESGGGLVQPGGSLRLSCAASGYTFTSYWMNWVRQAPGKGLVWVSRIDPYDSETHYNQKFKDRFTISVDKAKSTAYLQMNSLRAEDTAVYYCARGNWDDYWGQGTTVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1599 - protein, 486 aa, Artificial Sequence
  source: /note="Description of Artificial Sequence: Synthetic Chimeric Antigen Receptor sequence"
MALPVTALLLPLALLLHAARPDVQLTQSPSFLSASVGDRVTITCRASKSISKDLAWYQQKPGKAPKLLIYSGSTLQSGVPSRFSGSGSGTEFTLTISSLQPEDFATYYCQQHNKYPYTFGGGTKVEIKGGGGSGGGGSGGGGSGGGGSEVQLVQSGAEVKKPGESLRISCKGSGYTFTSYWMNWVRQMPGKGLEWMGRIDPYDSETHYNQKFKDHVTISVDKSISTAYLQWSSLKASDTAMYYCARGNWDDYWGQGTTVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1600 - protein, 486 aa, Artificial Sequence
  source: /note="Description of Artificial Sequence: Synthetic Chimeric Antigen Receptor sequence"
MALPVTALLLPLALLLHAARPDVQLTQSPSFLSASVGDRVTITCRASKSISKDLAWYQQKPGKAPKLLIYSGSTLQSGVPSRFSGSGSGTEFTLTISSLQPEDFATYYCQQHNKYPYTFGGGTKVEIKGGGGSGGGGSGGGGSGGGGSQVQLVQSGAEVKKPGASVKVSCKASGYTFTSYWMNWVRQAPGQGLEWMGRIDPYDSETHYNQKFKDRVTMTVDKSTSTAYMELSSLRSEDTAVYYCARGNWDDYWGQGTTVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1601 - protein, 486 aa, Artificial Sequence
  source: /note="Description of Artificial Sequence: Synthetic Chimeric Antigen Receptor sequence"
MALPVTALLLPLALLLHAARPDVQLTQSPSFLSASVGDRVTITCRASKSISKDLAWYQQKPGKAPKLLIYSGSTLQSGVPSRFSGSGSGTEFTLTISSLQPEDFATYYCQQHNKYPYTFGGGTKVEIKGGGGSGGGGSGGGGSGGGGSQVQLVQSGSELKKPGASVKVSCKASGYTFTSYWMNWVRQAPGQGLEWMGRIDPYDSETHYNQKFKDRFVFSVDKSVSTAYLQISSLKAEDTAVYYCARGNWDDYWGQGTTVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1602 - protein, 486 aa, Artificial Sequence
  source: /note="Description of Artificial Sequence: Synthetic Chimeric Antigen Receptor sequence"
MALPVTALLLPLALLLHAARPDVVMTQSPAFLSVTPGEKVTITCRASKSISKDLAWYQQKPDQAPKLLIYSGSTLQSGVPSRFSGSGSGTDFTFTISSLEAEDAATYYCQQHNKYPYTFGGGTKVEIKGGGGSGGGGSGGGGSGGGGSEVQLVESGGGLVQPGGSLRLSCAASGYTFTSYWMNWVRQAPGKGLVWVSRIDPYDSETHYNQKFKDRFTISVDKAKSTAYLQMNSLRAEDTAVYYCARGNWDDYWGQGTTVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1603 - protein, 486 aa, Artificial Sequence
  source: /note="Description of Artificial Sequence: Synthetic Chimeric Antigen Receptor sequence"
MALPVTALLLPLALLLHAARPDVVMTQSPAFLSVTPGEKVTITCRASKSISKDLAWYQQKPDQAPKLLIYSGSTLQSGVPSRFSGSGSGTDFTFTISSLEAEDAATYYCQQHNKYPYTFGGGTKVEIKGGGGSGGGGSGGGGSGGGGSEVQLVQSGAEVKKPGESLRISCKGSGYTFTSYWMNWVRQMPGKGLEWMGRIDPYDSETHYNQKFKDHVTISVDKSISTAYLQWSSLKASDTAMYYCARGNWDDYWGQGTTVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1604 - protein, 486 aa, Artificial Sequence
  source: /note="Description of Artificial Sequence: Synthetic Chimeric Antigen Receptor sequence"
MALPVTALLLPLALLLHAARPDVVMTQSPAFLSVTPGEKVTITCRASKSISKDLAWYQQKPDQAPKLLIYSGSTLQSGVPSRFSGSGSGTDFTFTISSLEAEDAATYYCQQHNKYPYTFGGGTKVEIKGGGGSGGGGSGGGGSGGGGSQVQLVQSGAEVKKPGASVKVSCKASGYTFTSYWMNWVRQAPGQGLEWMGRIDPYDSETHYNQKFKDRVTMTVDKSTSTAYMELSSLRSEDTAVYYCARGNWDDYWGQGTTVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1605 - protein, 486 aa, Artificial Sequence
  source: /note="Description of Artificial Sequence: Synthetic Chimeric Antigen Receptor sequence"
MALPVTALLLPLALLLHAARPDVVMTQSPAFLSVTPGEKVTITCRASKSISKDLAWYQQKPDQAPKLLIYSGSTLQSGVPSRFSGSGSGTDFTFTISSLEAEDAATYYCQQHNKYPYTFGGGTKVEIKGGGGSGGGGSGGGGSGGGGSQVQLVQSGSELKKPGASVKVSCKASGYTFTSYWMNWVRQAPGQGLEWMGRIDPYDSETHYNQKFKDRFVFSVDKSVSTAYLQISSLKAEDTAVYYCARGNWDDYWGQGTTVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1606 - protein, 486 aa, Artificial Sequence
  source: /note="Description of Artificial Sequence: Synthetic Chimeric Antigen Receptor sequence"
MALPVTALLLPLALLLHAARPDVVMTQSPDSLAVSLGERATINCRASKSISKDLAWYQQKPGQPPKLLIYSGSTLQSGVPDRFSGSGSGTDFTLTISSLQAEDVAVYYCQQHNKYPYTFGGGTKVEIKGGGGSGGGGSGGGGSGGGGSEVQLVESGGGLVQPGGSLRLSCAASGYTFTSYWMNWVRQAPGKGLVWVSRIDPYDSETHYNQKFKDRFTISVDKAKSTAYLQMNSLRAEDTAVYYCARGNWDDYWGQGTTVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1607 - protein, 486 aa, Artificial Sequence
  source: /note="Description of Artificial Sequence: Synthetic Chimeric Antigen Receptor sequence"
MALPVTALLLPLALLLHAARPDVVMTQSPDSLAVSLGERATINCRASKSISKDLAWYQQKPGQPPKLLIYSGSTLQSGVPDRFSGSGSGTDFTLTISSLQAEDVAVYYCQQHNKYPYTFGGGTKVEIKGGGGSGGGGSGGGGSGGGGSEVQLVQSGAEVKKPGESLRISCKGSGYTFTSYWMNWVRQMPGKGLEWMGRIDPYDSETHYNQKFKDHVTISVDKSISTAYLQWSSLKASDTAMYYCARGNWDDYWGQGTTVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1608 - protein, 486 aa, Artificial Sequence
  source: /note="Description of Artificial Sequence: Synthetic Chimeric Antigen Receptor sequence"
MALPVTALLLPLALLLHAARPDVVMTQSPDSLAVSLGERATINCRASKSISKDLAWYQQKPGQPPKLLIYSGSTLQSGVPDRFSGSGSGTDFTLTISSLQAEDVAVYYCQQHNKYPYTFGGGTKVEIKGGGGSGGGGSGGGGSGGGGSQVQLVQSGAEVKKPGASVKVSCKASGYTFTSYWMNWVRQAPGQGLEWMGRIDPYDSETHYNQKFKDRVTMTVDKSTSTAYMELSSLRSEDTAVYYCARGNWDDYWGQGTTVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1609 - protein, 486 aa, Artificial Sequence
  source: /note="Description of Artificial Sequence: Synthetic Chimeric Antigen Receptor sequence"
MALPVTALLLPLALLLHAARPDVVMTQSPDSLAVSLGERATINCRASKSISKDLAWYQQKPGQPPKLLIYSGSTLQSGVPDRFSGSGSGTDFTLTISSLQAEDVAVYYCQQHNKYPYTFGGGTKVEIKGGGGSGGGGSGGGGSGGGGSQVQLVQSGSELKKPGASVKVSCKASGYTFTSYWMNWVRQAPGQGLEWMGRIDPYDSETHYNQKFKDRFVFSVDKSVSTAYLQISSLKAEDTAVYYCARGNWDDYWGQGTTVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1610 - protein, 486 aa, Artificial Sequence
  source: /note="Description of Artificial Sequence: Synthetic Chimeric Antigen Receptor sequence"
MALPVTALLLPLALLLHAARPEVQLVESGGGLVQPGGSLRLSCAASGYTFTSYWMNWVRQAPGKGLVWVSRIDPYDSETHYNQKFKDRFTISVDKAKSTAYLQMNSLRAEDTAVYYCARGNWDDYWGQGTTVTVSSGGGGSGGGGSGGGGSGGGGSDVQLTQSPSFLSASVGDRVTITCRASKSISKDLAWYQQKPGKAPKLLIYSGSTLQSGVPSRFSGSGSGTEFTLTISSLQPEDFATYYCQQHNKYPYTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1611 - protein, 486 aa, Artificial Sequence
  source: /note="Description of Artificial Sequence: Synthetic Chimeric Antigen Receptor sequence"
MALPVTALLLPLALLLHAARPEVQLVESGGGLVQPGGSLRLSCAASGYTFTSYWMNWVRQAPGKGLVWVSRIDPYDSETHYNQKFKDRFTISVDKAKSTAYLQMNSLRAEDTAVYYCARGNWDDYWGQGTTVTVSSGGGGSGGGGSGGGGSGGGGSDVVMTQSPAFLSVTPGEKVTITCRASKSISKDLAWYQQKPDQAPKLLIYSGSTLQSGVPSRFSGSGSGTDFTFTISSLEAEDAATYYCQQHNKYPYTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1612 - protein, 486 aa, Artificial Sequence
  source: /note="Description of Artificial Sequence: Synthetic Chimeric Antigen Receptor sequence"
MALPVTALLLPLALLLHAARPEVQLVESGGGLVQPGGSLRLSCAASGYTFTSYWMNWVRQAPGKGLVWVSRIDPYDSETHYNQKFKDRFTISVDKAKSTAYLQMNSLRAEDTAVYYCARGNWDDYWGQGTTVTVSSGGGGSGGGGSGGGGSGGGGSDVVMTQSPDSLAVSLGERATINCRASKSISKDLAWYQQKPGQPPKLLIYSGSTLQSGVPDRFSGSGSGTDFTLTISSLQAEDVAVYYCQQHNKYPYTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1613 - protein, 486 aa, Artificial Sequence
  source: /note="Description of Artificial Sequence: Synthetic Chimeric Antigen Receptor sequence"
MALPVTALLLPLALLLHAARPEVQLVESGGGLVQPGGSLRLSCAASGYTFTSYWMNWVRQAPGKGLVWVSRIDPYDSETHYNQKFKDRFTISVDKAKSTAYLQMNSLRAEDTAVYYCARGNWDDYWGQGTTVTVSSGGGGSGGGGSGGGGSGGGGSEVVLTQSPATLSLSPGERATLSCRASKSISKDLAWYQQKPGQAPRLLIYSGSTLQSGIPARFSGSGSGTDFTLTISSLEPEDFAVYYCQQHNKYPYTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1614 - protein, 486 aa, Artificial Sequence
  source: /note="Description of Artificial Sequence: Synthetic Chimeric Antigen Receptor sequence"
MALPVTALLLPLALLLHAARPEVQLVQSGAEVKKPGESLRISCKGSGYTFTSYWMNWVRQMPGKGLEWMGRIDPYDSETHYNQKFKDHVTISVDKSISTAYLQWSSLKASDTAMYYCARGNWDDYWGQGTTVTVSSGGGGSGGGGSGGGGSGGGGSDVQLTQSPSFLSASVGDRVTITCRASKSISKDLAWYQQKPGKAPKLLIYSGSTLQSGVPSRFSGSGSGTEFTLTISSLQPEDFATYYCQQHNKYPYTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1615 - protein, 486 aa, Artificial Sequence
  source: /note="Description of Artificial Sequence: Synthetic Chimeric Antigen Receptor sequence"
MALPVTALLLPLALLLHAARPEVQLVQSGAEVKKPGESLRISCKGSGYTFTSYWMNWVRQMPGKGLEWMGRIDPYDSETHYNQKFKDHVTISVDKSISTAYLQWSSLKASDTAMYYCARGNWDDYWGQGTTVTVSSGGGGSGGGGSGGGGSGGGGSDVVMTQSPAFLSVTPGEKVTITCRASKSISKDLAWYQQKPDQAPKLLIYSGSTLQSGVPSRFSGSGSGTDFTFTISSLEAEDAATYYCQQHNKYPYTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1616 - protein, 486 aa, Artificial Sequence
  source: /note="Description of Artificial Sequence: Synthetic Chimeric Antigen Receptor sequence"
MALPVTALLLPLALLLHAARPEVQLVQSGAEVKKPGESLRISCKGSGYTFTSYWMNWVRQMPGKGLEWMGRIDPYDSETHYNQKFKDHVTISVDKSISTAYLQWSSLKASDTAMYYCARGNWDDYWGQGTTVTVSSGGGGSGGGGSGGGGSGGGGSDVVMTQSPDSLAVSLGERATINCRASKSISKDLAWYQQKPGQPPKLLIYSGSTLQSGVPDRFSGSGSGTDFTLTISSLQAEDVAVYYCQQHNKYPYTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1617 - protein, 486 aa, Artificial Sequence
  source: /note="Description of Artificial Sequence: Synthetic Chimeric Antigen Receptor sequence"
MALPVTALLLPLALLLHAARPEVQLVQSGAEVKKPGESLRISCKGSGYTFTSYWMNWVRQMPGKGLEWMGRIDPYDSETHYNQKFKDHVTISVDKSISTAYLQWSSLKASDTAMYYCARGNWDDYWGQGTTVTVSSGGGGSGGGGSGGGGSGGGGSEVVLTQSPATLSLSPGERATLSCRASKSISKDLAWYQQKPGQAPRLLIYSGSTLQSGIPARFSGSGSGTDFTLTISSLEPEDFAVYYCQQHNKYPYTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1618 - protein, 486 aa, Artificial Sequence
  source: /note="Description of Artificial Sequence: Synthetic Chimeric Antigen Receptor sequence"
MALPVTALLLPLALLLHAARPEVVLTQSPATLSLSPGERATLSCRASKSISKDLAWYQQKPGQAPRLLIYSGSTLQSGIPARFSGSGSGTDFTLTISSLEPEDFAVYYCQQHNKYPYTFGGGTKVEIKGGGGSGGGGSGGGGSGGGGSEVQLVESGGGLVQPGGSLRLSCAASGYTFTSYWMNWVRQAPGKGLVWVSRIDPYDSETHYNQKFKDRFTISVDKAKSTAYLQMNSLRAEDTAVYYCARGNWDDYWGQGTTVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1619 - protein, 486 aa, Artificial Sequence
  source: /note="Description of Artificial Sequence: Synthetic Chimeric Antigen Receptor sequence"
MALPVTALLLPLALLLHAARPEVVLTQSPATLSLSPGERATLSCRASKSISKDLAWYQQKPGQAPRLLIYSGSTLQSGIPARFSGSGSGTDFTLTISSLEPEDFAVYYCQQHNKYPYTFGGGTKVEIKGGGGSGGGGSGGGGSGGGGSEVQLVQSGAEVKKPGESLRISCKGSGYTFTSYWMNWVRQMPGKGLEWMGRIDPYDSETHYNQKFKDHVTISVDKSISTAYLQWSSLKASDTAMYYCARGNWDDYWGQGTTVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1620 - protein, 486 aa, Artificial Sequence
  source: /note="Description of Artificial Sequence: Synthetic Chimeric Antigen Receptor sequence"
MALPVTALLLPLALLLHAARPEVVLTQSPATLSLSPGERATLSCRASKSISKDLAWYQQKPGQAPRLLIYSGSTLQSGIPARFSGSGSGTDFTLTISSLEPEDFAVYYCQQHNKYPYTFGGGTKVEIKGGGGSGGGGSGGGGSGGGGSQVQLVQSGAEVKKPGASVKVSCKASGYTFTSYWMNWVRQAPGQGLEWMGRIDPYDSETHYNQKFKDRVTMTVDKSTSTAYMELSSLRSEDTAVYYCARGNWDDYWGQGTTVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1621 - protein, 486 aa, Artificial Sequence
  source: /note="Description of Artificial Sequence: Synthetic Chimeric Antigen Receptor sequence"
MALPVTALLLPLALLLHAARPEVVLTQSPATLSLSPGERATLSCRASKSISKDLAWYQQKPGQAPRLLIYSGSTLQSGIPARFSGSGSGTDFTLTISSLEPEDFAVYYCQQHNKYPYTFGGGTKVEIKGGGGSGGGGSGGGGSGGGGSQVQLVQSGSELKKPGASVKVSCKASGYTFTSYWMNWVRQAPGQGLEWMGRIDPYDSETHYNQKFKDRFVFSVDKSVSTAYLQISSLKAEDTAVYYCARGNWDDYWGQGTTVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1622 - protein, 486 aa, Artificial Sequence
  source: /note="Description of Artificial Sequence: Synthetic Chimeric Antigen Receptor sequence"
MALPVTALLLPLALLLHAARPQVQLVQSGAEVKKPGASVKVSCKASGYTFTSYWMNWVRQAPGQGLEWMGRIDPYDSETHYNQKFKDRVTMTVDKSTSTAYMELSSLRSEDTAVYYCARGNWDDYWGQGTTVTVSSGGGGSGGGGSGGGGSGGGGSDVQLTQSPSFLSASVGDRVTITCRASKSISKDLAWYQQKPGKAPKLLIYSGSTLQSGVPSRFSGSGSGTEFTLTISSLQPEDFATYYCQQHNKYPYTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1623 - protein, 486 aa, Artificial Sequence
  source: /note="Description of Artificial Sequence: Synthetic Chimeric Antigen Receptor sequence"
MALPVTALLLPLALLLHAARPQVQLVQSGAEVKKPGASVKVSCKASGYTFTSYWMNWVRQAPGQGLEWMGRIDPYDSETHYNQKFKDRVTMTVDKSTSTAYMELSSLRSEDTAVYYCARGNWDDYWGQGTTVTVSSGGGGSGGGGSGGGGSGGGGSDVVMTQSPAFLSVTPGEKVTITCRASKSISKDLAWYQQKPDQAPKLLIYSGSTLQSGVPSRFSGSGSGTDFTFTISSLEAEDAATYYCQQHNKYPYTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1624 - protein, 486 aa, Artificial Sequence
  source: /note="Description of Artificial Sequence: Synthetic Chimeric Antigen Receptor sequence"
MALPVTALLLPLALLLHAARPQVQLVQSGAEVKKPGASVKVSCKASGYTFTSYWMNWVRQAPGQGLEWMGRIDPYDSETHYNQKFKDRVTMTVDKSTSTAYMELSSLRSEDTAVYYCARGNWDDYWGQGTTVTVSSGGGGSGGGGSGGGGSGGGGSDVVMTQSPDSLAVSLGERATINCRASKSISKDLAWYQQKPGQPPKLLIYSGSTLQSGVPDRFSGSGSGTDFTLTISSLQAEDVAVYYCQQHNKYPYTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1625 - protein, 486 aa, Artificial Sequence
  source: /note="Description of Artificial Sequence: Synthetic Chimeric Antigen Receptor sequence"
MALPVTALLLPLALLLHAARPQVQLVQSGAEVKKPGASVKVSCKASGYTFTSYWMNWVRQAPGQGLEWMGRIDPYDSETHYNQKFKDRVTMTVDKSTSTAYMELSSLRSEDTAVYYCARGNWDDYWGQGTTVTVSSGGGGSGGGGSGGGGSGGGGSEVVLTQSPATLSLSPGERATLSCRASKSISKDLAWYQQKPGQAPRLLIYSGSTLQSGIPARFSGSGSGTDFTLTISSLEPEDFAVYYCQQHNKYPYTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1626 - protein, 486 aa, Artificial Sequence
  source: /note="Description of Artificial Sequence: Synthetic Chimeric Antigen Receptor sequence"
MALPVTALLLPLALLLHAARPQVQLVQSGSELKKPGASVKVSCKASGYTFTSYWMNWVRQAPGQGLEWMGRIDPYDSETHYNQKFKDRFVFSVDKSVSTAYLQISSLKAEDTAVYYCARGNWDDYWGQGTTVTVSSGGGGSGGGGSGGGGSGGGGSDVQLTQSPSFLSASVGDRVTITCRASKSISKDLAWYQQKPGKAPKLLIYSGSTLQSGVPSRFSGSGSGTEFTLTISSLQPEDFATYYCQQHNKYPYTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1627 - protein, 486 aa, Artificial Sequence
  source: /note="Description of Artificial Sequence: Synthetic Chimeric Antigen Receptor sequence"
MALPVTALLLPLALLLHAARPQVQLVQSGSELKKPGASVKVSCKASGYTFTSYWMNWVRQAPGQGLEWMGRIDPYDSETHYNQKFKDRFVFSVDKSVSTAYLQISSLKAEDTAVYYCARGNWDDYWGQGTTVTVSSGGGGSGGGGSGGGGSGGGGSDVVMTQSPAFLSVTPGEKVTITCRASKSISKDLAWYQQKPDQAPKLLIYSGSTLQSGVPSRFSGSGSGTDFTFTISSLEAEDAATYYCQQHNKYPYTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1628 - protein, 486 aa, Artificial Sequence
  source: /note="Description of Artificial Sequence: Synthetic Chimeric Antigen Receptor sequence"
MALPVTALLLPLALLLHAARPQVQLVQSGSELKKPGASVKVSCKASGYTFTSYWMNWVRQAPGQGLEWMGRIDPYDSETHYNQKFKDRFVFSVDKSVSTAYLQISSLKAEDTAVYYCARGNWDDYWGQGTTVTVSSGGGGSGGGGSGGGGSGGGGSDVVMTQSPDSLAVSLGERATINCRASKSISKDLAWYQQKPGQPPKLLIYSGSTLQSGVPDRFSGSGSGTDFTLTISSLQAEDVAVYYCQQHNKYPYTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1629 - protein, 486 aa, Artificial Sequence
  source: /note="Description of Artificial Sequence: Synthetic Chimeric Antigen Receptor sequence"
MALPVTALLLPLALLLHAARPQVQLVQSGSELKKPGASVKVSCKASGYTFTSYWMNWVRQAPGQGLEWMGRIDPYDSETHYNQKFKDRFVFSVDKSVSTAYLQISSLKAEDTAVYYCARGNWDDYWGQGTTVTVSSGGGGSGGGGSGGGGSGGGGSEVVLTQSPATLSLSPGERATLSCRASKSISKDLAWYQQKPGQAPRLLIYSGSTLQSGIPARFSGSGSGTDFTLTISSLEPEDFAVYYCQQHNKYPYTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1630 - protein, 487 aa, Artificial Sequence
  source: /note="Description of Artificial Sequence: Synthetic Chimeric Antigen Receptor sequence"
MGWSWIFLFLVSGTGGVLSEVQLQQSGPELVKPGASVKMSCKASGYTFTDYYMKWVKQSHGKSLEWIGDIIPSNGATFYNQKFKGKATLTVDRSSSTAYMHLNSLTSEDSAVYYCTRSHLLRASWFAYWGQGTLVTVSAASGGGGSGGGGSGGGGSMESQTQVLMSLLFWVSGTCGDFVMTQSPSSLTVTAGEKVTMSCKSSQSLLNSGNQKNYLTWYLQKPGQPPKLLIYWASTRESGVPDRFTGSGSGTDFTLTISSVQAEDLAVYYCQNDYSYPYTFGGGTKLEIKRGLAVSTISSFFPPGYQIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1631 - protein, 495 aa, Artificial Sequence
  source: /note="Description of Artificial Sequence: Synthetic Chimeric Antigen Receptor sequence"
MALPVTALLLPLALLLHAARPQIQLVQSGPELKKPGETVKISCKASGYIFTNYGMNWVKQAPGKSFKWMGWINTYTGESTYSADFKGRFAFSLETSASTAYLHINDLKNEDTATYFCARSGGYDPMDYWGQGTSVTVSSGGGCPYSNPSLCGGGGSDIVLTQSPASLAVSLGQRATISCRASESVDNYGNTFMHWYQQKPGQPPKLLIYRASNLESGIPARFSGSGSRTDFTLTINPVEADDVATYYCQQSNEDPPTFGAGTKLELKRSDPTTTPAPRPPTPAPTIASQPLSLRPEACRPAAGGAVHTRGLDFACDIYIWAPLAGTCGVLLLSLVITLYCRRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRE

SEQ ID NO: 1632 - protein, 499 aa, Artificial Sequence
  source: /note="Description of Artificial Sequence: Synthetic Chimeric Antigen Receptor sequence"
MALPVTALLLPLALLLHAARPEVKLVESGGGLVQPGGSLSLSCAASGFTFTDYYMSWVRQPPGKALEWLALIRSKADGYTTEYSASVKGRFTLSRDDSQSILYLQMNALRPEDSATYYCARDAAYYSYYSPEGAMDYWGQGTSVTVSSGGGGSGGGGSGGGGSMADYKDIVMTQSHKFMSTSVGDRVNITCKASQNVDSAVAWYQQKPGQSPKALIYSASYRYSGVPDRFTGRGSGTDFTLTISSVQAEDLAVYYCQQYYSTPWTFGGGTKLEIKRTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1633 - protein, 499 aa, Artificial Sequence
  source: /note="Description of Artificial Sequence: Synthetic Chimeric Antigen Receptor sequence"
MALPVTALLLPLALLLHAARPEVKLVESGGGLVQPGRSLRLSCTASGFTFTDYYMSWVRQAPGKGLEWVGLIRSKADGYTTEYSASVKGRFTISRDDSKSILYLQMNSLKTEDTAVYYCARDAAYYSYYSPEGAMDYWGQGTLVTVSSGGGGSGGGGSGGGGSMADYKDIQMTQSPSSVSASVGDRVTITCRASQNVDSAVAWYQQKPGKAPKALIYSASYRYSGVPSRFSGRGSGTDFTLTISSLQPEDFATYYCQQYYSTPWTFGQGTKVEIKRTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1634 - protein, 499 aa, Artificial Sequence
  source: /note="Description of Artificial Sequence: Synthetic Chimeric Antigen Receptor sequence"
MALPVTALLLPLALLLHAARPEVKLVESGGGLVQPGRSLRLSCTASGFTFTDYYMSWVRQAPGKGLEWVGLIRSKADGYTTEYSASVKGRFTISRDDSKSILYLQMNSLKTEDTAVYYCARDAAYYSYYSPEGAMDYWGQGTLVTVSSGGGGSGGGGSGGGGSMADYKDIQMTQSPSSVSASVGDRVTITCRASQNVDSAVAWYQQKPGKAPKALIYSASYRYSGVPSRFSGSGSGTDFTLTISSLQPEDFATYYCQQYYSTPWTFGQGTKVEIKRTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1635 - protein, 499 aa, Artificial Sequence
  source: /note="Description of Artificial Sequence: Synthetic Chimeric Antigen Receptor sequence"
MALPVTALLLPLALLLHAARPEVKLVESGGGLVQPGRSLRLSCTASGFTFTDYYMSWVRQAPGKGLEWVGLIRSKADGYTTEYSASVKGRFTISRDDSKSILYLQMNSLKTEDTAVYYCARDAAYYSYYSPEGAMDYWGQGTLVTVSSGGGGSGGGGSGGGGSMADYKDIQMTQSPSSVSASVGDRVTITCRASQNVDSAVAWYQQKPGKAPKLLIYSASYGQSGVPSRFSGSGSGTDFTLTISSLQPEDFATYYCQQYYSTPWTFGQGTKVEIKRTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1636 - protein, 499 aa, Artificial Sequence
  source: /note="Description of Artificial Sequence: Synthetic Chimeric Antigen Receptor sequence"
MALPVTALLLPLALLLHAARPEVKLVESGGGLVQPGRSLRLSCTASGFTFTDYYMSWVRQAPGKGLEWVGLIRSKADGYTTEYSASVKGRFTISRDDSKSILYLQMNSLKTEDTAVYYCARDAAYYSYYSPEGAMDYWGQGTLVTVSSGGGGSGGGGSGGGGSMADYKDIQMTQSPSSVSASVGDRVTITCRASQNVDSAVAWYQQKPGKAPKLLIYSASYRQSGVPSRFSGSGSGTDFTLTISSLQPEDFATYYCQQYYSTPWTFGQGTKVEIKRTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1637 - protein, 499 aa, Artificial Sequence
  source: /note="Description of Artificial Sequence: Synthetic Chimeric Antigen Receptor sequence"
MALPVTALLLPLALLLHAARPEVKLVESGGGLVQPGRSLRLSCTASGFTFTDYYMSWVRQAPGKGLEWVGLIRSKADGYTTEYSASVKGRFTISRDDSKSILYLQMNSLKTEDTAVYYCARDAAYYSYYSPEGAMDYWGQGTLVTVSSGGGGSGGGGSGGGGSMADYKDIQMTQSPSSVSASVGDRVTITCRASQNVDSAVAWYQQKPGKAPKLLIYSASYRYSGVPSRFSGSGSGTDFTLTISSLQPEDFATYYCQQYYSTPWTFGQGTKVEIKRTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1638 - protein, 499 aa, Artificial Sequence
  source: /note="Description of Artificial Sequence: Synthetic Chimeric Antigen Receptor sequence"
MALPVTALLLPLALLLHAARPEVKLVESGGGLVQPGRSLRLSCTASGFTFTDYYMSWVRQAPGKGLEWVGLIRSKADGYTTEYSASVKGRFTISRDDSKSILYLQMNSLKTEDTAVYYCARDAAYYSYYSPEGAMDYWGQGTLVTVSSGGGGSGGGGSGGGGSMADYKDIVMTQSPSSVSASVGDRVTITCRASQNVDSAVAWYQQKPGKAPKALIYSASYRYSGVPSRFSGRGSGTDFTLTISSLQPEDFATYYCQQYYSTPWTFGQGTKVEIKRTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1639 - protein, 499 aa, Artificial Sequence
  source: /note="Description of Artificial Sequence: Synthetic Chimeric Antigen Receptor sequence"
MALPVTALLLPLALLLHAARPEVQLVESGGGLVQPGRSLRLSCTASGFTFTDYYMSWVRQAPGKGLEWVGFIRSKADGYTTEYAASVKGRFTISRDDSKSIAYLQMNSLKTEDTAVYYCARDAAYYSYYSPEGAMDYWGQGTLVTVSSGGGGSGGGGSGGGGSMADYKDIQMTQSPSSVSASVGDRVTITCRASQNVDSAVAWYQQKPGKAPKALIYSASYRYSGVPSRFSGRGSGTDFTLTISSLQPEDFATYYCQQYYSTPWTFGQGTKVEIKRTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1640 - protein, 499 aa, Artificial Sequence
  source: /note="Description of Artificial Sequence: Synthetic Chimeric Antigen Receptor sequence"
MALPVTALLLPLALLLHAARPEVQLVESGGGLVQPGRSLRLSCTASGFTFTDYYMSWVRQAPGKGLEWVGFIRSKADGYTTEYAASVKGRFTISRDDSKSIAYLQMNSLKTEDTAVYYCARDAAYYSYYSPEGAMDYWGQGTLVTVSSGGGGSGGGGSGGGGSMADYKDIQMTQSPSSVSASVGDRVTITCRASQNVDSAVAWYQQKPGKAPKALIYSASYRYSGVPSRFSGSGSGTDFTLTISSLQPEDFATYYCQQYYSTPWTFGQGTKVEIKRTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1641 - protein, 499 aa, Artificial Sequence
  source: /note="Description of Artificial Sequence: Synthetic Chimeric Antigen Receptor sequence"
MALPVTALLLPLALLLHAARPEVQLVESGGGLVQPGRSLRLSCTASGFTFTDYYMSWVRQAPGKGLEWVGFIRSKADGYTTEYAASVKGRFTISRDDSKSIAYLQMNSLKTEDTAVYYCARDAAYYSYYSPEGAMDYWGQGTLVTVSSGGGGSGGGGSGGGGSMADYKDIQMTQSPSSVSASVGDRVTITCRASQNVDSAVAWYQQKPGKAPKLLIYSASYGQSGVPSRFSGSGSGTDFTLTISSLQPEDFATYYCQQYYSTPWTFGQGTKVEIKRTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1642 - protein, 499 aa, Artificial Sequence
  source: /note="Description of Artificial Sequence: Synthetic Chimeric Antigen Receptor sequence"
MALPVTALLLPLALLLHAARPEVQLVESGGGLVQPGRSLRLSCTASGFTFTDYYMSWVRQAPGKGLEWVGFIRSKADGYTTEYAASVKGRFTISRDDSKSIAYLQMNSLKTEDTAVYYCARDAAYYSYYSPEGAMDYWGQGTLVTVSSGGGGSGGGGSGGGGSMADYKDIQMTQSPSSVSASVGDRVTITCRASQNVDSAVAWYQQKPGKAPKLLIYSASYRQSGVPSRFSGSGSGTDFTLTISSLQPEDFATYYCQQYYSTPWTFGQGTKVEIKRTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1643 - protein, 499 aa, Artificial Sequence
  source: /note="Description of Artificial Sequence: Synthetic Chimeric Antigen Receptor sequence"
MALPVTALLLPLALLLHAARPEVQLVESGGGLVQPGRSLRLSCTASGFTFTDYYMSWVRQAPGKGLEWVGFIRSKADGYTTEYAASVKGRFTISRDDSKSIAYLQMNSLKTEDTAVYYCARDAAYYSYYSPEGAMDYWGQGTLVTVSSGGGGSGGGGSGGGGSMADYKDIQMTQSPSSVSASVGDRVTITCRASQNVDSAVAWYQQKPGKAPKLLIYSASYRYSGVPSRFSGSGSGTDFTLTISSLQPEDFATYYCQQYYSTPWTFGQGTKVEIKRTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1644 - protein, 499 aa, Artificial Sequence
  source: /note="Description of Artificial Sequence: Synthetic Chimeric Antigen Receptor sequence"
MALPVTALLLPLALLLHAARPEVQLVESGGGLVQPGRSLRLSCTASGFTFTDYYMSWVRQAPGKGLEWVGFIRSKADGYTTEYAASVKGRFTISRDDSKSIAYLQMNSLKTEDTAVYYCARDAAYYSYYSPEGAMDYWGQGTLVTVSSGGGGSGGGGSGGGGSMADYKDIVMTQSPSSVSASVGDRVTITCRASQNVDSAVAWYQQKPGKAPKALIYSASYRYSGVPSRFSGRGSGTDFTLTISSLQPEDFATYYCQQYYSTPWTFGQGTKVEIKRTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1645 - protein, 499 aa, Artificial Sequence
  source: /note="Description of Artificial Sequence: Synthetic Chimeric Antigen Receptor sequence"
MALPVTALLLPLALLLHAARPEVQLVESGGGLVQPGRSLRLSCTASGFTFTDYYMSWVRQAPGKGLEWVGFIRSKADGYTTEYAASVKGRFTISRDDSKSIAYLQMNSLKTEDTAVYYCTRDAAYYSYYSPEGAMDYWGQGTLVTVSSGGGGSGGGGSGGGGSMADYKDIQMTQSPSSVSASVGDRVTITCRASQNVDSAVAWYQQKPGKAPKALIYSASYRYSGVPSRFSGRGSGTDFTLTISSLQPEDFATYYCQQYYSTPWTFGQGTKVEIKRTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1646 - protein, 499 aa, Artificial Sequence
  source: /note="Description of Artificial Sequence: Synthetic Chimeric Antigen Receptor sequence"
MALPVTALLLPLALLLHAARPEVQLVESGGGLVQPGRSLRLSCTASGFTFTDYYMSWVRQAPGKGLEWVGFIRSKADGYTTEYAASVKGRFTISRDDSKSIAYLQMNSLKTEDTAVYYCTRDAAYYSYYSPEGAMDYWGQGTLVTVSSGGGGSGGGGSGGGGSMADYKDIQMTQSPSSVSASVGDRVTITCRASQNVDSAVAWYQQKPGKAPKALIYSASYRYSGVPSRFSGSGSGTDFTLTISSLQPEDFATYYCQQYYSTPWTFGQGTKVEIKRTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1647 - protein, 499 aa, Artificial Sequence
  source: /note="Description of Artificial Sequence: Synthetic Chimeric Antigen Receptor sequence"
MALPVTALLLPLALLLHAARPEVQLVESGGGLVQPGRSLRLSCTASGFTFTDYYMSWVRQAPGKGLEWVGFIRSKADGYTTEYAASVKGRFTISRDDSKSIAYLQMNSLKTEDTAVYYCTRDAAYYSYYSPEGAMDYWGQGTLVTVSSGGGGSGGGGSGGGGSMADYKDIQMTQSPSSVSASVGDRVTITCRASQNVDSAVAWYQQKPGKAPKLLIYSASYGQSGVPSRFSGSGSGTDFTLTISSLQPEDFATYYCQQYYSTPWTFGQGTKVEIKRTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1648 - protein, 499 aa, Artificial Sequence
  source: /note="Description of Artificial Sequence: Synthetic Chimeric Antigen Receptor sequence"
MALPVTALLLPLALLLHAARPEVQLVESGGGLVQPGRSLRLSCTASGFTFTDYYMSWVRQAPGKGLEWVGFIRSKADGYTTEYAASVKGRFTISRDDSKSIAYLQMNSLKTEDTAVYYCTRDAAYYSYYSPEGAMDYWGQGTLVTVSSGGGGSGGGGSGGGGSMADYKDIQMTQSPSSVSASVGDRVTITCRASQNVDSAVAWYQQKPGKAPKLLIYSASYRQSGVPSRFSGSGSGTDFTLTISSLQPEDFATYYCQQYYSTPWTFGQGTKVEIKRTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1649 - protein, 499 aa, Artificial Sequence
  source: /note="Description of Artificial Sequence: Synthetic Chimeric Antigen Receptor sequence"
MALPVTALLLPLALLLHAARPEVQLVESGGGLVQPGRSLRLSCTASGFTFTDYYMSWVRQAPGKGLEWVGFIRSKADGYTTEYAASVKGRFTISRDDSKSIAYLQMNSLKTEDTAVYYCTRDAAYYSYYSPEGAMDYWGQGTLVTVSSGGGGSGGGGSGGGGSMADYKDIQMTQSPSSVSASVGDRVTITCRASQNVDSAVAWYQQKPGKAPKLLIYSASYRYSGVPSRFSGSGSGTDFTLTISSLQPEDFATYYCQQYYSTPWTFGQGTKVEIKRTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1650 - protein, 499 aa, Artificial Sequence
  source: /note="Description of Artificial Sequence: Synthetic Chimeric Antigen Receptor sequence"
MALPVTALLLPLALLLHAARPEVQLVESGGGLVQPGRSLRLSCTASGFTFTDYYMSWVRQAPGKGLEWVGFIRSKADGYTTEYAASVKGRFTISRDDSKSIAYLQMNSLKTEDTAVYYCTRDAAYYSYYSPEGAMDYWGQGTLVTVSSGGGGSGGGGSGGGGSMADYKDIVMTQSPSSVSASVGDRVTITCRASQNVDSAVAWYQQKPGKAPKALIYSASYRYSGVPSRFSGRGSGTDFTLTISSLQPEDFATYYCQQYYSTPWTFGQGTKVEIKRTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1651 - protein, 499 aa, Artificial Sequence
  source: /note="Description of Artificial Sequence: Synthetic Chimeric Antigen Receptor sequence"
MALPVTALLLPLALLLHAARPEVQLVESGGGLVQPGRSLRLSCTASGFTFTDYYMSWVRQAPGKGLEWVGFIRSKADGYTTEYSASVKGRFTISRDDSKSIAYLQMNSLKTEDTAVYYCARDAAYYSYYSPEGAMDYWGQGTLVTVSSGGGGSGGGGSGGGGSMADYKDIQMTQSPSSVSASVGDRVTITCRASQNVDSAVAWYQQKPGKAPKALIYSASYRYSGVPSRFSGRGSGTDFTLTISSLQPEDFATYYCQQYYSTPWTFGQGTKVEIKRTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1652 - protein, 499 aa, Artificial Sequence
  source: /note="Description of Artificial Sequence: Synthetic Chimeric Antigen Receptor sequence"
MALPVTALLLPLALLLHAARPEVQLVESGGGLVQPGRSLRLSCTASGFTFTDYYMSWVRQAPGKGLEWVGFIRSKADGYTTEYSASVKGRFTISRDDSKSIAYLQMNSLKTEDTAVYYCARDAAYYSYYSPEGAMDYWGQGTLVTVSSGGGGSGGGGSGGGGSMADYKDIQMTQSPSSVSASVGDRVTITCRASQNVDSAVAWYQQKPGKAPKALIYSASYRYSGVPSRFSGSGSGTDFTLTISSLQPEDFATYYCQQYYSTPWTFGQGTKVEIKRTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1653 - protein, 499 aa, Artificial Sequence
  source: /note="Description of Artificial Sequence: Synthetic Chimeric Antigen Receptor sequence"
MALPVTALLLPLALLLHAARPEVQLVESGGGLVQPGRSLRLSCTASGFTFTDYYMSWVRQAPGKGLEWVGFIRSKADGYTTEYSASVKGRFTISRDDSKSIAYLQMNSLKTEDTAVYYCARDAAYYSYYSPEGAMDYWGQGTLVTVSSGGGGSGGGGSGGGGSMADYKDIQMTQSPSSVSASVGDRVTITCRASQNVDSAVAWYQQKPGKAPKLLIYSASYGQSGVPSRFSGSGSGTDFTLTISSLQPEDFATYYCQQYYSTPWTFGQGTKVEIKRTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1654 - protein, 499 aa, Artificial Sequence
  source: /note="Description of Artificial Sequence: Synthetic Chimeric Antigen Receptor sequence"
MALPVTALLLPLALLLHAARPEVQLVESGGGLVQPGRSLRLSCTASGFTFTDYYMSWVRQAPGKGLEWVGFIRSKADGYTTEYSASVKGRFTISRDDSKSIAYLQMNSLKTEDTAVYYCARDAAYYSYYSPEGAMDYWGQGTLVTVSSGGGGSGGGGSGGGGSMADYKDIQMTQSPSSVSASVGDRVTITCRASQNVDSAVAWYQQKPGKAPKLLIYSASYRQSGVPSRFSGSGSGTDFTLTISSLQPEDFATYYCQQYYSTPWTFGQGTKVEIKRTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1655 - protein, 499 aa, Artificial Sequence
  source: /note="Description of Artificial Sequence: Synthetic Chimeric Antigen Receptor sequence"
MALPVTALLLPLALLLHAARPEVQLVESGGGLVQPGRSLRLSCTASGFTFTDYYMSWVRQAPGKGLEWVGFIRSKADGYTTEYSASVKGRFTISRDDSKSIAYLQMNSLKTEDTAVYYCARDAAYYSYYSPEGAMDYWGQGTLVTVSSGGGGSGGGGSGGGGSMADYKDIQMTQSPSSVSASVGDRVTITCRASQNVDSAVAWYQQKPGKAPKLLIYSASYRYSGVPSRFSGSGSGTDFTLTISSLQPEDFATYYCQQYYSTPWTFGQGTKVEIKRTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1656 - protein, 499 aa, Artificial Sequence
  source: /note="Description of Artificial Sequence: Synthetic Chimeric Antigen Receptor sequence"
MALPVTALLLPLALLLHAARPEVQLVESGGGLVQPGRSLRLSCTASGFTFTDYYMSWVRQAPGKGLEWVGFIRSKADGYTTEYSASVKGRFTISRDDSKSIAYLQMNSLKTEDTAVYYCARDAAYYSYYSPEGAMDYWGQGTLVTVSSGGGGSGGGGSGGGGSMADYKDIVMTQSPSSVSASVGDRVTITCRASQNVDSAVAWYQQKPGKAPKALIYSASYRYSGVPSRFSGRGSGTDFTLTISSLQPEDFATYYCQQYYSTPWTFGQGTKVEIKRTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1657 - protein, 499 aa, Artificial Sequence
  source: /note="Description of Artificial Sequence: Synthetic Chimeric Antigen Receptor sequence"
MALPVTALLLPLALLLHAARPEVQLVESGGGLVQPGRSLRLSCTASGFTFTDYYMSWVRQAPGKGLEWVGLIRSKADGYTTEYAASVKGRFTISRDDSKSIAYLQMNSLKTEDTAVYYCARDAAYYSYYSPEGAMDYWGQGTLVTVSSGGGGSGGGGSGGGGSMADYKDIQMTQSPSSVSASVGDRVTITCRASQNVDSAVAWYQQKPGKAPKALIYSASYRYSGVPSRFSGRGSGTDFTLTISSLQPEDFATYYCQQYYSTPWTFGQGTKVEIKRTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1658 - protein, 499 aa, Artificial Sequence
  source: /note="Description of Artificial Sequence: Synthetic Chimeric Antigen Receptor sequence"
MALPVTALLLPLALLLHAARPEVQLVESGGGLVQPGRSLRLSCTASGFTFTDYYMSWVRQAPGKGLEWVGLIRSKADGYTTEYAASVKGRFTISRDDSKSIAYLQMNSLKTEDTAVYYCARDAAYYSYYSPEGAMDYWGQGTLVTVSSGGGGSGGGGSGGGGSMADYKDIQMTQSPSSVSASVGDRVTITCRASQNVDSAVAWYQQKPGKAPKALIYSASYRYSGVPSRFSGSGSGTDFTLTISSLQPEDFATYYCQQYYSTPWTFGQGTKVEIKRTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1659 - protein, 499 aa, Artificial Sequence
  source: /note="Description of Artificial Sequence: Synthetic Chimeric Antigen Receptor sequence"
MALPVTALLLPLALLLHAARPEVQLVESGGGLVQPGRSLRLSCTASGFTFTDYYMSWVRQAPGKGLEWVGLIRSKADGYTTEYAASVKGRFTISRDDSKSIAYLQMNSLKTEDTAVYYCARDAAYYSYYSPEGAMDYWGQGTLVTVSSGGGGSGGGGSGGGGSMADYKDIQMTQSPSSVSASVGDRVTITCRASQNVDSAVAWYQQKPGKAPKLLIYSASYGQSGVPSRFSGSGSGTDFTLTISSLQPEDFATYYCQQYYSTPWTFGQGTKVEIKRTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1660 - protein, 499 aa, Artificial Sequence
  source: /note="Description of Artificial Sequence: Synthetic Chimeric Antigen Receptor sequence"
MALPVTALLLPLALLLHAARPEVQLVESGGGLVQPGRSLRLSCTASGFTFTDYYMSWVRQAPGKGLEWVGLIRSKADGYTTEYAASVKGRFTISRDDSKSIAYLQMNSLKTEDTAVYYCARDAAYYSYYSPEGAMDYWGQGTLVTVSSGGGGSGGGGSGGGGSMADYKDIQMTQSPSSVSASVGDRVTITCRASQNVDSAVAWYQQKPGKAPKLLIYSASYRQSGVPSRFSGSGSGTDFTLTISSLQPEDFATYYCQQYYSTPWTFGQGTKVEIKRTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1661 - protein, 499 aa, Artificial Sequence
  source: /note="Description of Artificial Sequence: Synthetic Chimeric Antigen Receptor sequence"
MALPVTALLLPLALLLHAARPEVQLVESGGGLVQPGRSLRLSCTASGFTFTDYYMSWVRQAPGKGLEWVGLIRSKADGYTTEYAASVKGRFTISRDDSKSIAYLQMNSLKTEDTAVYYCARDAAYYSYYSPEGAMDYWGQGTLVTVSSGGGGSGGGGSGGGGSMADYKDIQMTQSPSSVSASVGDRVTITCRASQNVDSAVAWYQQKPGKAPKLLIYSASYRYSGVPSRFSGSGSGTDFTLTISSLQPEDFATYYCQQYYSTPWTFGQGTKVEIKRTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1662 - protein, 499 aa, Artificial Sequence
  source: /note="Description of Artificial Sequence: Synthetic Chimeric Antigen Receptor sequence"
MALPVTALLLPLALLLHAARPEVQLVESGGGLVQPGRSLRLSCTASGFTFTDYYMSWVRQAPGKGLEWVGLIRSKADGYTTEYAASVKGRFTISRDDSKSIAYLQMNSLKTEDTAVYYCARDAAYYSYYSPEGAMDYWGQGTLVTVSSGGGGSGGGGSGGGGSMADYKDIVMTQSPSSVSASVGDRVTITCRASQNVDSAVAWYQQKPGKAPKALIYSASYRYSGVPSRFSGRGSGTDFTLTISSLQPEDFATYYCQQYYSTPWTFGQGTKVEIKRTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1663 - protein, 499 aa, Artificial Sequence
  source: /note="Description of Artificial Sequence: Synthetic Chimeric Antigen Receptor sequence"
MALPVTALLLPLALLLHAARPEVQLVESGGGLVQPGRSLRLSCTASGFTFTDYYMSWVRQAPGKGLEWVGLIRSKADGYTTEYSASVKGRFTISRDDSKSIAYLQMNSLKTEDTAVYYCARDAAYYSYYSPEGAMDYWGQGTLVTVSSGGGGSGGGGSGGGGSMADYKDIQMTQSPSSVSASVGDRVTITCRASQNVDSAVAWYQQKPGKAPKALIYSASYRYSGVPSRFSGRGSGTDFTLTISSLQPEDFATYYCQQYYSTPWTFGQGTKVEIKRTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1664 - protein, 499 aa, Artificial Sequence
  source: /note="Description of Artificial Sequence: Synthetic Chimeric Antigen Receptor sequence"
MALPVTALLLPLALLLHAARPEVQLVESGGGLVQPGRSLRLSCTASGFTFTDYYMSWVRQAPGKGLEWVGLIRSKADGYTTEYSASVKGRFTISRDDSKSIAYLQMNSLKTEDTAVYYCARDAAYYSYYSPEGAMDYWGQGTLVTVSSGGGGSGGGGSGGGGSMADYKDIQMTQSPSSVSASVGDRVTITCRASQNVDSAVAWYQQKPGKAPKALIYSASYRYSGVPSRFSGSGSGTDFTLTISSLQPEDFATYYCQQYYSTPWTFGQGTKVEIKRTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1665 - protein, 499 aa, Artificial Sequence
  source: /note="Description of Artificial Sequence: Synthetic Chimeric Antigen Receptor sequence"
MALPVTALLLPLALLLHAARPEVQLVESGGGLVQPGRSLRLSCTASGFTFTDYYMSWVRQAPGKGLEWVGLIRSKADGYTTEYSASVKGRFTISRDDSKSIAYLQMNSLKTEDTAVYYCARDAAYYSYYSPEGAMDYWGQGTLVTVSSGGGGSGGGGSGGGGSMADYKDIQMTQSPSSVSASVGDRVTITCRASQNVDSAVAWYQQKPGKAPKLLIYSASYGQSGVPSRFSGSGSGTDFTLTISSLQPEDFATYYCQQYYSTPWTFGQGTKVEIKRTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1666 - protein, 499 aa, Artificial Sequence
  source: /note="Description of Artificial Sequence: Synthetic Chimeric Antigen Receptor sequence"
MALPVTALLLPLALLLHAARPEVQLVESGGGLVQPGRSLRLSCTASGFTFTDYYMSWVRQAPGKGLEWVGLIRSKADGYTTEYSASVKGRFTISRDDSKSIAYLQMNSLKTEDTAVYYCARDAAYYSYYSPEGAMDYWGQGTLVTVSSGGGGSGGGGSGGGGSMADYKDIQMTQSPSSVSASVGDRVTITCRASQNVDSAVAWYQQKPGKAPKLLIYSASYRQSGVPSRFSGSGSGTDFTLTISSLQPEDFATYYCQQYYSTPWTFGQGTKVEIKRTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1667 - protein, 499 aa, Artificial Sequence
  source: /note="Description of Artificial Sequence: Synthetic Chimeric Antigen Receptor sequence"
MALPVTALLLPLALLLHAARPEVQLVESGGGLVQPGRSLRLSCTASGFTFTDYYMSWVRQAPGKGLEWVGLIRSKADGYTTEYSASVKGRFTISRDDSKSIAYLQMNSLKTEDTAVYYCARDAAYYSYYSPEGAMDYWGQGTLVTVSSGGGGSGGGGSGGGGSMADYKDIQMTQSPSSVSASVGDRVTITCRASQNVDSAVAWYQQKPGKAPKLLIYSASYRYSGVPSRFSGSGSGTDFTLTISSLQPEDFATYYCQQYYSTPWTFGQGTKVEIKRTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1668 - protein, 499 aa, Artificial Sequence
  source: /note="Description of Artificial Sequence: Synthetic Chimeric Antigen Receptor sequence"
MALPVTALLLPLALLLHAARPEVQLVESGGGLVQPGRSLRLSCTASGFTFTDYYMSWVRQAPGKGLEWVGLIRSKADGYTTEYSASVKGRFTISRDDSKSIAYLQMNSLKTEDTAVYYCARDAAYYSYYSPEGAMDYWGQGTLVTVSSGGGGSGGGGSGGGGSMADYKDIVMTQSPSSVSASVGDRVTITCRASQNVDSAVAWYQQKPGKAPKALIYSASYRYSGVPSRFSGRGSGTDFTLTISSLQPEDFATYYCQQYYSTPWTFGQGTKVEIKRTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1669 - protein, 499 aa, Artificial Sequence
  source: /note="Description of Artificial Sequence: Synthetic Chimeric Antigen Receptor sequence"
MALPVTALLLPLALLLHAARPEVQLVESGGGLVQPGRSLRLSCTASGFTFTDYYMSWVRQAPGKGLEWVGLIRSKADGYTTEYSASVKGRFTISRDDSKSILYLQMNSLKTEDTAVYYCARDAAYYSYYSPEGAMDYWGQGTLVTVSSGGGGSGGGGSGGGGSMADYKDIQMTQSPSSVSASVGDRVTITCRASQNVDSAVAWYQQKPGKAPKALIYSASYRYSGVPSRFSGRGSGTDFTLTISSLQPEDFATYYCQQYYSTPWTFGQGTKVEIKRTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1670 - protein, 499 aa, Artificial Sequence
  source: /note="Description of Artificial Sequence: Synthetic Chimeric Antigen Receptor sequence"
MALPVTALLLPLALLLHAARPEVQLVESGGGLVQPGRSLRLSCTASGFTFTDYYMSWVRQAPGKGLEWVGLIRSKADGYTTEYSASVKGRFTISRDDSKSILYLQMNSLKTEDTAVYYCARDAAYYSYYSPEGAMDYWGQGTLVTVSSGGGGSGGGGSGGGGSMADYKDIQMTQSPSSVSASVGDRVTITCRASQNVDSAVAWYQQKPGKAPKALIYSASYRYSGVPSRFSGSGSGTDFTLTISSLQPEDFATYYCQQYYSTPWTFGQGTKVEIKRTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1671 - protein, 499 aa, Artificial Sequence
  source: /note="Description of Artificial Sequence: Synthetic Chimeric Antigen Receptor sequence"
MALPVTALLLPLALLLHAARPEVQLVESGGGLVQPGRSLRLSCTASGFTFTDYYMSWVRQAPGKGLEWVGLIRSKADGYTTEYSASVKGRFTISRDDSKSILYLQMNSLKTEDTAVYYCARDAAYYSYYSPEGAMDYWGQGTLVTVSSGGGGSGGGGSGGGGSMADYKDIQMTQSPSSVSASVGDRVTITCRASQNVDSAVAWYQQKPGKAPKLLIYSASYGQSGVPSRFSGSGSGTDFTLTISSLQPEDFATYYCQQYYSTPWTFGQGTKVEIKRTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1672 - protein, 499 aa, Artificial Sequence
  source: /note="Description of Artificial Sequence: Synthetic Chimeric Antigen Receptor sequence"
MALPVTALLLPLALLLHAARPEVQLVESGGGLVQPGRSLRLSCTASGFTFTDYYMSWVRQAPGKGLEWVGLIRSKADGYTTEYSASVKGRFTISRDDSKSILYLQMNSLKTEDTAVYYCARDAAYYSYYSPEGAMDYWGQGTLVTVSSGGGGSGGGGSGGGGSMADYKDIQMTQSPSSVSASVGDRVTITCRASQNVDSAVAWYQQKPGKAPKLLIYSASYRQSGVPSRFSGSGSGTDFTLTISSLQPEDFATYYCQQYYSTPWTFGQGTKVEIKRTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1673 - protein, 499 aa, Artificial Sequence
  source: /note="Description of Artificial Sequence: Synthetic Chimeric Antigen Receptor sequence"
MALPVTALLLPLALLLHAARPEVQLVESGGGLVQPGRSLRLSCTASGFTFTDYYMSWVRQAPGKGLEWVGLIRSKADGYTTEYSASVKGRFTISRDDSKSILYLQMNSLKTEDTAVYYCARDAAYYSYYSPEGAMDYWGQGTLVTVSSGGGGSGGGGSGGGGSMADYKDIQMTQSPSSVSASVGDRVTITCRASQNVDSAVAWYQQKPGKAPKLLIYSASYRYSGVPSRFSGSGSGTDFTLTISSLQPEDFATYYCQQYYSTPWTFGQGTKVEIKRTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1674 - protein, 499 aa, Artificial Sequence
  source: /note="Description of Artificial Sequence: Synthetic Chimeric Antigen Receptor sequence"
MALPVTALLLPLALLLHAARPEVQLVESGGGLVQPGRSLRLSCTASGFTFTDYYMSWVRQAPGKGLEWVGLIRSKADGYTTEYSASVKGRFTISRDDSKSILYLQMNSLKTEDTAVYYCARDAAYYSYYSPEGAMDYWGQGTLVTVSSGGGGSGGGGSGGGGSMADYKDIVMTQSPSSVSASVGDRVTITCRASQNVDSAVAWYQQKPGKAPKALIYSASYRYSGVPSRFSGRGSGTDFTLTISSLQPEDFATYYCQQYYSTPWTFGQGTKVEIKRTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1675 - protein, 501 aa, Artificial Sequence
  source: /note="Description of Artificial Sequence: Synthetic Chimeric Antigen Receptor sequence"
MALPVTALLLPLALLLHAARPQIQLVQSGPELKKPGETVKISCKASGYIFTNYGMNWVKQAPGKSFKWMGWINTYTGESTYSADFKGRFAFSLETSASTAYLHINDLKNEDTATYFCARSGGYDPMDYWGQGTSVTVSSGGGGGGCPYSNPSLCGGGGGGGSDIVLTQSPASLAVSLGQRATISCRASESVDNYGNTFMHWYQQKPGQPPKLLIYRASNLESGIPARFSGSGSRTDFTLTINPVEADDVATYYCQQSNEDPPTFGAGTKLELKRSDPTTTPAPRPPTPAPTIASQPLSLRPEACRPAAGGAVHTRGLDFACDIYIWAPLAGTCGVLLLSLVITLYCRRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRE

SEQ ID NO: 1676 - protein, 508 aa, Artificial Sequence
  source: /note="Description of Artificial Sequence: Synthetic Chimeric Antigen Receptor sequence"
MALPVTALLLPLALLLHAARPGGGGSCPYSNPSLCGQIQLVQSGPELKKPGETVKISCKASGYIFTNYGMNWVKQAPGKSFKWMGWINTYTGESTYSADFKGRFAFSLETSASTAYLHINDLKNEDTATYFCARSGGYDPMDYWGQGTSVTVSSGGGGSGGGGSGGGGSDIVLTQSPASLAVSLGQRATISCRASESVDNYGNTFMHWYQQKPGQPPKLLIYRASNLESGIPARFSGSGSRTDFTLTINPVEADDVATYYCQQSNEDPPTFGAGTKLELKRSDPTTTPAPRPPTPAPTIASQPLSLRPEACRPAAGGAVHTRGLDFACDIYIWAPLAGTCGVLLLSLVITLYCRRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRE

SEQ ID NO: 1677 - protein, 510 aa, Artificial Sequence
  source: /note="Description of Artificial Sequence: Synthetic Chimeric Antigen Receptor sequence"
WTWRFLFVVAAATGVQSQVQLLQSGAEVKKPGSSVKVSCKASGGTFSTYAISWVRQAPGQGLEWMGGIIPIFGIVNYAQKFQGRVTITADESTSTAYMELSSLRSEDTAVYYCARGGGSGPDVLDIWGQGTMVTVSSASTGGGGSGGGGSGGGGSMDMRVPAQLLGLLLLWLPGARCVIWMTQSPSLLSASTGDRVTISCRMSQGIRSYLAWYQQKPGKAPELLIYAASTLQSGVPSRFSGSGSGTDFTLTISSLQSEDFATYYCQQYYSFPYTFGQGTKLEIKRTVTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1678 - protein, 511 aa, Artificial Sequence
  source: /note="Description of Artificial Sequence: Synthetic Chimeric Antigen Receptor sequence"
MALPVTALLLPLALLLHAARPQIQLVQSGPELKKPGETVKISCKASGYIFTNYGMNWVKQAPGKSFKWMGWINTYTGESTYSADFKGRFAFSLETSASTAYLHINDLKNEDTATYFCARSGGYDPMDYWGQGTSVTVSSGGGGSGGGGSGGGGSDIVLTQSPASLAVSLGQRATISCRASESVDNYGNTFMHWYQQKPGQPPKLLIYRASNLESGIPARFSGSGSRTDFTLTINPVEADDVATYYCQQSNEDPPTFGAGTKLELKRSDPGSGGGGSCPYSNPSLCAPTTTPAPRPPTPAPTIASQPLSLRPEACRPAAGGAVHTRGLDFACDIYIWAPLAGTCGVLLLSLVITLYCRRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRE

SEQ ID NO: 1679 - protein, 513 aa, Artificial Sequence
  source: /note="Description of Artificial Sequence: Synthetic Chimeric Antigen Receptor sequence"
MGWSWIFLFLVSGTGGVLSEVQLQQSGPELVKPGASVKMSCKASGYTFTDYYMKWVKQSHGKSLEWIGDIIPSNGATFYNQKFKGKATLTVDRSSSTAYMHLNSLTSEDSAVYYCTRSHLLRASWFAYWGQGTLVTVSAASGGGGSGGGGSGGGGSMESQTQVLMSLLFWVSGTCGDFVMTQSPSSLTVTAGEKVTMSCKSSQSLLNSGNQKNYLTWYLQKPGQPPKLLIYWASTRESGVPDRFTGSGSGTDFTLTISSVQAEDLAVYYCQNDYSYPYTFGGGTKLEIKRTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1680 - protein, 514 aa, Artificial Sequence
  source: /note="Description of Artificial Sequence: Synthetic Chimeric Antigen Receptor sequence"
MALPVTALLLPLALLLHAARPGGGGSCPYSNPSLCSGGGGSGQIQLVQSGPELKKPGETVKISCKASGYIFTNYGMNWVKQAPGKSFKWMGWINTYTGESTYSADFKGRFAFSLETSASTAYLHINDLKNEDTATYFCARSGGYDPMDYWGQGTSVTVSSGGGGSGGGGSGGGGSDIVLTQSPASLAVSLGQRATISCRASESVDNYGNTFMHWYQQKPGQPPKLLIYRASNLESGIPARFSGSGSRTDFTLTINPVEADDVATYYCQQSNEDPPTFGAGTKLELKRSDPTTTPAPRPPTPAPTIASQPLSLRPEACRPAAGGAVHTRGLDFACDIYIWAPLAGTCGVLLLSLVITLYCRRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRE

SEQ ID NO: 1681 - protein, 516 aa, Artificial Sequence
  source: /note="Description of Artificial Sequence: Synthetic Chimeric Antigen Receptor sequence"
MGWSWIFLFLVSGTGGVLSEVQLQQSGPELVKPGASVKMSCKASGYTFTDYYMKWVKQSHGKSLEWIGDIIPSNGATFYNQKFKGKATLTVDRSSSTAYMHLNSLTSEDSAVYYCTRSHLLRASWFAYWGQGTLVTVSAASGGGGSGGGGSGGGGSMESQTQVLMSLLFWVSGTCGDFVMTQSPSSLTVTAGEKVTMSCKSSQSLLNSGNQKNYLTWYLQKPGQPPKLLIYWASTRESGVPDRFTGSGSGTDFTLTISSVQAEDLAVYYCQNDYSYPYTFGGGTKLEIKRTTTPAPRPPTPAPTIASQPLSLRPEACRPAAGGAVHTRGLDFACDIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1682 - protein, 517 aa, Artificial Sequence
  source: /note="Description of Artificial Sequence: Synthetic Chimeric Antigen Receptor sequence"
MALPVTALLLPLALLLHAARPQIQLVQSGPELKKPGETVKISCKASGYIFTNYGMNWVKQAPGKSFKWMGWINTYTGESTYSADFKGRFAFSLETSASTAYLHINDLKNEDTATYFCARSGGYDPMDYWGQGTSVTVSSGGGGSGGGGSGGGGSDIVLTQSPASLAVSLGQRATISCRASESVDNYGNTFMHWYQQKPGQPPKLLIYRASNLESGIPARFSGSGSRTDFTLTINPVEADDVATYYCQQSNEDPPTFGAGTKLELKRSDPGSGGGGSCPYSNPSLCSGGGGSAPTTTPAPRPPTPAPTIASQPLSLRPEACRPAAGGAVHTRGLDFACDIYIWAPLAGTCGVLLLSLVITLYCRRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRE

SEQ ID NO: 1683 - protein, 520 aa, Artificial Sequence
  source: /note="Description of Artificial Sequence: Synthetic Chimeric Antigen Receptor sequence"
GPVPPSTALRYLIEELVNITQNQKAPLCNGSMVWSINLTAGMYCAALESLINVSGCSAIEKTQRMLSGFCPHKVSAGQFSSLHVRDTKIEVAQFVKDLLLHLKKLFREGRFNESKYGPPCPPCPAPEFEGGPSVFLFPPKPKDTLMISRTPEVTCVVVDVSQEDPEVQFNWYVDGVEVHNAKTKPREEQFQSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKMALIVLGGVAGLLLFIGLGIFFKRGRKKLLYIFKQPFMRPVQTTQEEDGCSCRFPEEEEGGCELGGGRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1684 - protein, 523 aa, Artificial Sequence
  source: /note="Description of Artificial Sequence: Synthetic Chimeric Antigen Receptor sequence"
MALPVTALLLPLALLLHAARPGGGGSCPYSNPSLCSGGGGSCPYSNPSLCGQIQLVQSGPELKKPGETVKISCKASGYIFTNYGMNWVKQAPGKSFKWMGWINTYTGESTYSADFKGRFAFSLETSASTAYLHINDLKNEDTATYFCARSGGYDPMDYWGQGTSVTVSSGGGGSGGGGSGGGGSDIVLTQSPASLAVSLGQRATISCRASESVDNYGNTFMHWYQQKPGQPPKLLIYRASNLESGIPARFSGSGSRTDFTLTINPVEADDVATYYCQQSNEDPPTFGAGTKLELKRSDPTTTPAPRPPTPAPTIASQPLSLRPEACRPAAGGAVHTRGLDFACDIYIWAPLAGTCGVLLLSLVITLYCRRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRE

SEQ ID NO: 1685 - protein, 526 aa, Artificial Sequence
  source: /note="Description of Artificial Sequence: Synthetic Chimeric Antigen Receptor sequence"
MALPVTALLLPLALLLHAARPEVKLVESGGGLVQPGGSLSLSCAASGFTFTDYYMSWVRQPPGKALEWLALIRSKADGYTTEYSASVKGRFTLSRDDSQSILYLQMNALRPEDSATYYCARDAAYYSYYSPEGAMDYWGQGTSVTVSSGGGGSGGGGSGGGGSMADYKDIVMTQSHKFMSTSVGDRVNITCKASQNVDSAVAWYQQKPGQSPKALIYSASYRYSGVPDRFTGRGSGTDFTLTISSVQAEDLAVYYCQQYYSTPWTFGGGTKLEIKRGSGGGGSCPYSNPSLCSGGGGSCPYSNPSLCSGGGGSAPTIASQPLSLRPEACRPAAGGAVHTRGLDFACDIYIWAPLAGTCGVLLLSLVITLYCRRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRE

SEQ ID NO: 1686 - protein, 526 aa, Artificial Sequence
  source: /note="Description of Artificial Sequence: Synthetic Chimeric Antigen Receptor sequence"
MALPVTALLLPLALLLHAARPQIQLVQSGPELKKPGETVKISCKASGYIFTNYGMNWVKQAPGKSFKWMGWINTYTGESTYSADFKGRFAFSLETSASTAYLHINDLKNEDTATYFCARSGGYDPMDYWGQGTSVTVSSGGGGSGGGGSGGGGSDIVLTQSPASLAVSLGQRATISCRASESVDNYGNTFMHWYQQKPGQPPKLLIYRASNLESGIPARFSGSGSRTDFTLTINPVEADDVATYYCQQSNEDPPTFGAGTKLELKRSDPGSGGGGSCPYSNPSLCSGGGGSCPYSNPSLCAPTTTPAPRPPTPAPTIASQPLSLRPEACRPAAGGAVHTRGLDFACDIYIWAPLAGTCGVLLLSLVITLYCRRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRE

SEQ ID NO: 1687 - protein, 529 aa, Artificial Sequence
  source: /note="Description of Artificial Sequence: Synthetic Chimeric Antigen Receptor sequence"
MALPVTALLLPLALLLHAARPGGGGSCPYSNPSLCSGGGGSCPYSNPSLCSGGGGSGQIQLVQSGPELKKPGETVKISCKASGYIFTNYGMNWVKQAPGKSFKWMGWINTYTGESTYSADFKGRFAFSLETSASTAYLHINDLKNEDTATYFCARSGGYDPMDYWGQGTSVTVSSGGGGSGGGGSGGGGSDIVLTQSPASLAVSLGQRATISCRASESVDNYGNTFMHWYQQKPGQPPKLLIYRASNLESGIPARFSGSGSRTDFTLTINPVEADDVATYYCQQSNEDPPTFGAGTKLELKRSDPTTTPAPRPPTPAPTIASQPLSLRPEACRPAAGGAVHTRGLDFACDIYIWAPLAGTCGVLLLSLVITLYCRRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRE

SEQ ID NO: 1688 - protein, 531 aa, Artificial Sequence
  source: /note="Description of Artificial Sequence: Synthetic Chimeric Antigen Receptor sequence"
MALPVTALLLPLALLLHAARPEVKLVESGGGLVQPGRSLRLSCTASGFTFTDYYMSWVRQAPGKGLEWVGLIRSKADGYTTEYSASVKGRFTISRDDSKSILYLQMNSLKTEDTAVYYCARDAAYYSYYSPEGAMDYWGQGTLVTVSSGGGGSGGGGSGGGGSMADYKDIQMTQSPSSVSASVGDRVTITCRASQNVDSAVAWYQQKPGKAPKALIYSASYRYSGVPSRFSGRGSGTDFTLTISSLQPEDFATYYCQQYYSTPWTFGQGTKVEIKREPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYC

SEQ ID NO: 1689 - protein, 531 aa, Artificial Sequence
  source: /note="Description of Artificial Sequence: Synthetic Chimeric Antigen Receptor sequence"
MALPVTALLLPLALLLHAARPEVKLVESGGGLVQPGRSLRLSCTASGFTFTDYYMSWVRQAPGKGLEWVGLIRSKADGYTTEYSASVKGRFTISRDDSKSILYLQMNSLKTEDTAVYYCARDAAYYSYYSPEGAMDYWGQGTLVTVSSGGGGSGGGGSGGGGSMADYKDIQMTQSPSSVSASVGDRVTITCRASQNVDSAVAWYQQKPGKAPKALIYSASYRYSGVPSRFSGSGSGTDFTLTISSLQPEDFATYYCQQYYSTPWTFGQGTKVEIKREPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYC

SEQ ID NO: 1690 - protein, 531 aa, Artificial Sequence
  source: /note="Description of Artificial Sequence: Synthetic Chimeric Antigen Receptor sequence"
MALPVTALLLPLALLLHAARPEVKLVESGGGLVQPGRSLRLSCTASGFTFTDYYMSWVRQAPGKGLEWVGLIRSKADGYTTEYSASVKGRFTISRDDSKSILYLQMNSLKTEDTAVYYCARDAAYYSYYSPEGAMDYWGQGTLVTVSSGGGGSGGGGSGGGGSMADYKDIQMTQSPSSVSASVGDRVTITCRASQNVDSAVAWYQQKPGKAPKLLIYSASYGQSGVPSRFSGSGSGTDFTLTISSLQPEDFATYYCQQYYSTPWTFGQGTKVEIKREPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYC

SEQ ID NO: 1691 - protein, 531 aa, Artificial Sequence
  source: /note="Description of Artificial Sequence: Synthetic Chimeric Antigen Receptor sequence"
MALPVTALLLPLALLLHAARPEVKLVESGGGLVQPGRSLRLSCTASGFTFTDYYMSWVRQAPGKGLEWVGLIRSKADGYTTEYSASVKGRFTISRDDSKSILYLQMNSLKTEDTAVYYCARDAAYYSYYSPEGAMDYWGQGTLVTVSSGGGGSGGGGSGGGGSMADYKDIQMTQSPSSVSASVGDRVTITCRASQNVDSAVAWYQQKPGKAPKLLIYSASYRQSGVPSRFSGSGSGTDFTLTISSLQPEDFATYYCQQYYSTPWTFGQGTKVEIKREPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYC

SEQ ID NO: 1692 - protein, 531 aa, Artificial Sequence
  source: /note="Description of Artificial Sequence: Synthetic Chimeric Antigen Receptor sequence"
MALPVTALLLPLALLLHAARPEVKLVESGGGLVQPGRSLRLSCTASGFTFTDYYMSWVRQAPGKGLEWVGLIRSKADGYTTEYSASVKGRFTISRDDSKSILYLQMNSLKTEDTAVYYCARDAAYYSYYSPEGAMDYWGQGTLVTVSSGGGGSGGGGSGGGGSMADYKDIQMTQSPSSVSASVGDRVTITCRASQNVDSAVAWYQQKPGKAPKLLIYSASYRYSGVPSRFSGSGSGTDFTLTISSLQPEDFATYYCQQYYSTPWTFGQGTKVEIKREPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYC

SEQ ID NO: 1693 - protein, 531 aa, Artificial Sequence
  source: /note="Description of Artificial Sequence: Synthetic Chimeric Antigen Receptor sequence"
MALPVTALLLPLALLLHAARPEVKLVESGGGLVQPGRSLRLSCTASGFTFTDYYMSWVRQAPGKGLEWVGLIRSKADGYTTEYSASVKGRFTISRDDSKSILYLQMNSLKTEDTAVYYCARDAAYYSYYSPEGAMDYWGQGTLVTVSSGGGGSGGGGSGGGGSMADYKDIVMTQSPSSVSASVGDRVTITCRASQNVDSAVAWYQQKPGKAPKALIYSASYRYSGVPSRFSGRGSGTDFTLTISSLQPEDFATYYCQQYYSTPWTFGQGTKVEIKREPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYC

SEQ ID NO: 1694 - protein, 531 aa, Artificial Sequence
  source: /note="Description of Artificial Sequence: Synthetic Chimeric Antigen Receptor sequence"
MALPVTALLLPLALLLHAARPEVQLVESGGGLVQPGRSLRLSCTASGFTFTDYYMSWVRQAPGKGLEWVGFIRSKADGYTTEYAASVKGRFTISRDDSKSIAYLQMNSLKTEDTAVYYCARDAAYYSYYSPEGAMDYWGQGTLVTVSSGGGGSGGGGSGGGGSMADYKDIQMTQSPSSVSASVGDRVTITCRASQNVDSAVAWYQQKPGKAPKALIYSASYRYSGVPSRFSGRGSGTDFTLTISSLQPEDFATYYCQQYYSTPWTFGQGTKVEIKREPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYC

SEQ ID NO: 1695 - protein, 531 aa, Artificial Sequence
  source: /note="Description of Artificial Sequence: Synthetic Chimeric Antigen Receptor sequence"
MALPVTALLLPLALLLHAARPEVQLVESGGGLVQPGRSLRLSCTASGFTFTDYYMSWVRQAPGKGLEWVGFIRSKADGYTTEYAASVKGRFTISRDDSKSIAYLQMNSLKTEDTAVYYCARDAAYYSYYSPEGAMDYWGQGTLVTVSSGGGGSGGGGSGGGGSMADYKDIQMTQSPSSVSASVGDRVTITCRASQNVDSAVAWYQQKPGKAPKALIYSASYRYSGVPSRFSGSGSGTDFTLTISSLQPEDFATYYCQQYYSTPWTFGQGTKVEIKREPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYC

SEQ ID NO: 1696 - protein, 531 aa, Artificial Sequence
  source: /note="Description of Artificial Sequence: Synthetic Chimeric Antigen Receptor sequence"
MALPVTALLLPLALLLHAARPEVQLVESGGGLVQPGRSLRLSCTASGFTFTDYYMSWVRQAPGKGLEWVGFIRSKADGYTTEYAASVKGRFTISRDDSKSIAYLQMNSLKTEDTAVYYCARDAAYYSYYSPEGAMDYWGQGTLVTVSSGGGGSGGGGSGGGGSMADYKDIQMTQSPSSVSASVGDRVTITCRASQNVDSAVAWYQQKPGKAPKLLIYSASYGQSGVPSRFSGSGSGTDFTLTISSLQPEDFATYYCQQYYSTPWTFGQGTKVEIKREPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYC

SEQ ID NO: 1697 - protein, 531 aa, Artificial Sequence
  source: /note="Description of Artificial Sequence: Synthetic Chimeric Antigen Receptor sequence"
MALPVTALLLPLALLLHAARPEVQLVESGGGLVQPGRSLRLSCTASGFTFTDYYMSWVRQAPGKGLEWVGFIRSKADGYTTEYAASVKGRFTISRDDSKSIAYLQMNSLKTEDTAVYYCARDAAYYSYYSPEGAMDYWGQGTLVTVSSGGGGSGGGGSGGGGSMADYKDIQMTQSPSSVSASVGDRVTITCRASQNVDSAVAWYQQKPGKAPKLLIYSASYRQSGVPSRFSGSGSGTDFTLTISSLQPEDFATYYCQQYYSTPWTFGQGTKVEIKREPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYC

SEQ ID NO: 1698 - protein, 531 aa, Artificial Sequence
  source: /note="Description of Artificial Sequence: Synthetic Chimeric Antigen Receptor sequence"
MALPVTALLLPLALLLHAARPEVQLVESGGGLVQPGRSLRLSCTASGFTFTDYYMSWVRQAPGKGLEWVGFIRSKADGYTTEYAASVKGRFTISRDDSKSIAYLQMNSLKTEDTAVYYCARDAAYYSYYSPEGAMDYWGQGTLVTVSSGGGGSGGGGSGGGGSMADYKDIQMTQSPSSVSASVGDRVTITCRASQNVDSAVAWYQQKPGKAPKLLIYSASYRYSGVPSRFSGSGSGTDFTLTISSLQPEDFATYYCQQYYSTPWTFGQGTKVEIKREPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYC

SEQ ID NO: 1699 - protein, 531 aa, Artificial Sequence
  source: /note="Description of Artificial Sequence: Synthetic Chimeric Antigen Receptor sequence"
MALPVTALLLPLALLLHAARPEVQLVESGGGLVQPGRSLRLSCTASGFTFTDYYMSWVRQAPGKGLEWVGFIRSKADGYTTEYAASVKGRFTISRDDSKSIAYLQMNSLKTEDTAVYYCARDAAYYSYYSPEGAMDYWGQGTLVTVSSGGGGSGGGGSGGGGSMADYKDIVMTQSPSSVSASVGDRVTITCRASQNVDSAVAWYQQKPGKAPKALIYSASYRYSGVPSRFSGRGSGTDFTLTISSLQPEDFATYYCQQYYSTPWTFGQGTKVEIKREPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYC

SEQ ID NO: 1700 - protein, 531 aa, Artificial Sequence
  source: /note="Description of Artificial Sequence: Synthetic Chimeric Antigen Receptor sequence"
MALPVTALLLPLALLLHAARPEVQLVESGGGLVQPGRSLRLSCTASGFTFTDYYMSWVRQAPGKGLEWVGFIRSKADGYTTEYAASVKGRFTISRDDSKSIAYLQMNSLKTEDTAVYYCTRDAAYYSYYSPEGAMDYWGQGTLVTVSSGGGGSGGGGSGGGGSMADYKDIQMTQSPSSVSASVGDRVTITCRASQNVDSAVAWYQQKPGKAPKALIYSASYRYSGVPSRFSGRGSGTDFTLTISSLQPEDFATYYCQQYYSTPWTFGQGTKVEIKREPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYC

SEQ ID NO: 1701 - protein, 531 aa, Artificial Sequence
  source: /note="Description of Artificial Sequence: Synthetic Chimeric Antigen Receptor sequence"
MALPVTALLLPLALLLHAARPEVQLVESGGGLVQPGRSLRLSCTASGFTFTDYYMSWVRQAPGKGLEWVGFIRSKADGYTTEYAASVKGRFTISRDDSKSIAYLQMNSLKTEDTAVYYCTRDAAYYSYYSPEGAMDYWGQGTLVTVSSGGGGSGGGGSGGGGSMADYKDIQMTQSPSSVSASVGDRVTITCRASQNVDSAVAWYQQKPGKAPKALIYSASYRYSGVPSRFSGSGSGTDFTLTISSLQPEDFATYYCQQYYSTPWTFGQGTKVEIKREPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYC

SEQ ID NO: 1702 - protein, 531 aa, Artificial Sequence
  source: /note="Description of Artificial Sequence: Synthetic Chimeric Antigen Receptor sequence"
MALPVTALLLPLALLLHAARPEVQLVESGGGLVQPGRSLRLSCTASGFTFTDYYMSWVRQAPGKGLEWVGFIRSKADGYTTEYAASVKGRFTISRDDSKSIAYLQMNSLKTEDTAVYYCTRDAAYYSYYSPEGAMDYWGQGTLVTVSSGGGGSGGGGSGGGGSMADYKDIQMTQSPSSVSASVGDRVTITCRASQNVDSAVAWYQQKPGKAPKLLIYSASYGQSGVPSRFSGSGSGTDFTLTISSLQPEDFATYYCQQYYSTPWTFGQGTKVEIKREPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYC

SEQ ID NO: 1703 - protein, 531 aa, Artificial Sequence
  source: /note="Description of Artificial Sequence: Synthetic Chimeric Antigen Receptor sequence"
MALPVTALLLPLALLLHAARPEVQLVESGGGLVQPGRSLRLSCTASGFTFTDYYMSWVRQAPGKGLEWVGFIRSKADGYTTEYAASVKGRFTISRDDSKSIAYLQMNSLKTEDTAVYYCTRDAAYYSYYSPEGAMDYWGQGTLVTVSSGGGGSGGGGSGGGGSMADYKDIQMTQSPSSVSASVGDRVTITCRASQNVDSAVAWYQQKPGKAPKLLIYSASYRQSGVPSRFSGSGSGTDFTLTISSLQPEDFATYYCQQYYSTPWTFGQGTKVEIKREPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYC

SEQ ID NO: 1704 - protein, 531 aa, Artificial Sequence
  source: /note="Description of Artificial Sequence: Synthetic Chimeric Antigen Receptor sequence"
MALPVTALLLPLALLLHAARPEVQLVESGGGLVQPGRSLRLSCTASGFTFTDYYMSWVRQAPGKGLEWVGFIRSKADGYTTEYAASVKGRFTISRDDSKSIAYLQMNSLKTEDTAVYYCTRDAAYYSYYSPEGAMDYWGQGTLVTVSSGGGGSGGGGSGGGGSMADYKDIQMTQSPSSVSASVGDRVTITCRASQNVDSAVAWYQQKPGKAPKLLIYSASYRYSGVPSRFSGSGSGTDFTLTISSLQPEDFATYYCQQYYSTPWTFGQGTKVEIKREPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYC

SEQ ID NO: 1705 - protein, 531 aa, Artificial Sequence
  source: /note="Description of Artificial Sequence: Synthetic Chimeric Antigen Receptor sequence"
MALPVTALLLPLALLLHAARPEVQLVESGGGLVQPGRSLRLSCTASGFTFTDYYMSWVRQAPGKGLEWVGFIRSKADGYTTEYAASVKGRFTISRDDSKSIAYLQMNSLKTEDTAVYYCTRDAAYYSYYSPEGAMDYWGQGTLVTVSSGGGGSGGGGSGGGGSMADYKDIVMTQSPSSVSASVGDRVTITCRASQNVDSAVAWYQQKPGKAPKALIYSASYRYSGVPSRFSGRGSGTDFTLTISSLQPEDFATYYCQQYYSTPWTFGQGTKVEIKREPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYC

SEQ ID NO: 1706 - protein, 531 aa, Artificial Sequence
  source: /note="Description of Artificial Sequence: Synthetic Chimeric Antigen Receptor sequence"
MALPVTALLLPLALLLHAARPEVQLVESGGGLVQPGRSLRLSCTASGFTFTDYYMSWVRQAPGKGLEWVGFIRSKADGYTTEYSASVKGRFTISRDDSKSIAYLQMNSLKTEDTAVYYCARDAAYYSYYSPEGAMDYWGQGTLVTVSSGGGGSGGGGSGGGGSMADYKDIQMTQSPSSVSASVGDRVTITCRASQNVDSAVAWYQQKPGKAPKALIYSASYRYSGVPSRFSGRGSGTDFTLTISSLQPEDFATYYCQQYYSTPWTFGQGTKVEIKREPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYC

SEQ ID NO: 1707 - protein, 531 aa, Artificial Sequence
  source: /note="Description of Artificial Sequence: Synthetic Chimeric Antigen Receptor sequence"
MALPVTALLLPLALLLHAARPEVQLVESGGGLVQPGRSLRLSCTASGFTFTDYYMSWVRQAPGKGLEWVGFIRSKADGYTTEYSASVKGRFTISRDDSKSIAYLQMNSLKTEDTAVYYCARDAAYYSYYSPEGAMDYWGQGTLVTVSSGGGGSGGGGSGGGGSMADYKDIQMTQSPSSVSASVGDRVTITCRASQNVDSAVAWYQQKPGKAPKALIYSASYRYSGVPSRFSGSGSGTDFTLTISSLQPEDFATYYCQQYYSTPWTFGQGTKVEIKREPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYC

SEQ ID NO: 1708 - protein, 531 aa, Artificial Sequence
  source: /note="Description of Artificial Sequence: Synthetic Chimeric Antigen Receptor sequence"
MALPVTALLLPLALLLHAARPEVQLVESGGGLVQPGRSLRLSCTASGFTFTDYYMSWVRQAPGKGLEWVGFIRSKADGYTTEYSASVKGRFTISRDDSKSIAYLQMNSLKTEDTAVYYCARDAAYYSYYSPEGAMDYWGQGTLVTVSSGGGGSGGGGSGGGGSMADYKDIQMTQSPSSVSASVGDRVTITCRASQNVDSAVAWYQQKPGKAPKLLIYSASYGQSGVPSRFSGSGSGTDFTLTISSLQPEDFATYYCQQYYSTPWTFGQGTKVEIKREPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYC

SEQ ID NO: 1709 - protein, 531 aa, Artificial Sequence
  source: /note="Description of Artificial Sequence: Synthetic Chimeric Antigen Receptor sequence"
MALPVTALLLPLALLLHAARPEVQLVESGGGLVQPGRSLRLSCTASGFTFTDYYMSWVRQAPGKGLEWVGFIRSKADGYTTEYSASVKGRFTISRDDSKSIAYLQMNSLKTEDTAVYYCARDAAYYSYYSPEGAMDYWGQGTLVTVSSGGGGSGGGGSGGGGSMADYKDIQMTQSPSSVSASVGDRVTITCRASQNVDSAVAWYQQKPGKAPKLLIYSASYRQSGVPSRFSGSGSGTDFTLTISSLQPEDFATYYCQQYYSTPWTFGQGTKVEIKREPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYC

SEQ ID NO: 1710 - protein, 531 aa, Artificial Sequence
  source: /note="Description of Artificial Sequence: Synthetic Chimeric Antigen Receptor sequence"
MALPVTALLLPLALLLHAARPEVQLVESGGGLVQPGRSLRLSCTASGFTFTDYYMSWVRQAPGKGLEWVGFIRSKADGYTTEYSASVKGRFTISRDDSKSIAYLQMNSLKTEDTAVYYCARDAAYYSYYSPEGAMDYWGQGTLVTVSSGGGGSGGGGSGGGGSMADYKDIQMTQSPSSVSASVGDRVTITCRASQNVDSAVAWYQQKPGKAPKLLIYSASYRYSGVPSRFSGSGSGTDFTLTISSLQPEDFATYYCQQYYSTPWTFGQGTKVEIKREPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYC

SEQ ID NO: 1711 - protein, 531 aa, Artificial Sequence
  source: /note="Description of Artificial Sequence: Synthetic Chimeric Antigen Receptor sequence"
MALPVTALLLPLALLLHAARPEVQLVESGGGLVQPGRSLRLSCTASGFTFTDYYMSWVRQAPGKGLEWVGFIRSKADGYTTEYSASVKGRFTISRDDSKSIAYLQMNSLKTEDTAVYYCARDAAYYSYYSPEGAMDYWGQGTLVTVSSGGGGSGGGGSGGGGSMADYKDIVMTQSPSSVSASVGDRVTITCRASQNVDSAVAWYQQKPGKAPKALIYSASYRYSGVPSRFSGRGSGTDFTLTISSLQPEDFATYYCQQYYSTPWTFGQGTKVEIKREPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYC

SEQ ID NO: 1712 - protein, 531 aa, Artificial Sequence
  source: /note="Description of Artificial Sequence: Synthetic Chimeric Antigen Receptor sequence"
MALPVTALLLPLALLLHAARPEVQLVESGGGLVQPGRSLRLSCTASGFTFTDYYMSWVRQAPGKGLEWVGLIRSKADGYTTEYAASVKGRFTISRDDSKSIAYLQMNSLKTEDTAVYYCARDAAYYSYYSPEGAMDYWGQGTLVTVSSGGGGSGGGGSGGGGSMADYKDIQMTQSPSSVSASVGDRVTITCRASQNVDSAVAWYQQKPGKAPKALIYSASYRYSGVPSRFSGRGSGTDFTLTISSLQPEDFATYYCQQYYSTPWTFGQGTKVEIKREPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYC

SEQ ID NO: 1713 - protein, 531 aa, Artificial Sequence
  source: /note="Description of Artificial Sequence: Synthetic Chimeric Antigen Receptor sequence"
MALPVTALLLPLALLLHAARPEVQLVESGGGLVQPGRSLRLSCTASGFTFTDYYMSWVRQAPGKGLEWVGLIRSKADGYTTEYAASVKGRFTISRDDSKSIAYLQMNSLKTEDTAVYYCARDAAYYSYYSPEGAMDYWGQGTLVTVSSGGGGSGGGGSGGGGSMADYKDIQMTQSPSSVSASVGDRVTITCRASQNVDSAVAWYQQKPGKAPKALIYSASYRYSGVPSRFSGSGSGTDFTLTISSLQPEDFATYYCQQYYSTPWTFGQGTKVEIKREPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYC

SEQ ID NO: 1714 - protein, 531 aa, Artificial Sequence
  source: /note="Description of Artificial Sequence: Synthetic Chimeric Antigen Receptor sequence"
MALPVTALLLPLALLLHAARPEVQLVESGGGLVQPGRSLRLSCTASGFTFTDYYMSWVRQAPGKGLEWVGLIRSKADGYTTEYAASVKGRFTISRDDSKSIAYLQMNSLKTEDTAVYYCARDAAYYSYYSPEGAMDYWGQGTLVTVSSGGGGSGGGGSGGGGSMADYKDIQMTQSPSSVSASVGDRVTITCRASQNVDSAVAWYQQKPGKAPKLLIYSASYGQSGVPSRFSGSGSGTDFTLTISSLQPEDFATYYCQQYYSTPWTFGQGTKVEIKREPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYC

SEQ ID NO: 1715 - protein, 531 aa, Artificial Sequence
  source: /note="Description of Artificial Sequence: Synthetic Chimeric Antigen Receptor sequence"
MALPVTALLLPLALLLHAARPEVQLVESGGGLVQPGRSLRLSCTASGFTFTDYYMSWVRQAPGKGLEWVGLIRSKADGYTTEYAASVKGRFTISRDDSKSIAYLQMNSLKTEDTAVYYCARDAAYYSYYSPEGAMDYWGQGTLVTVSSGGGGSGGGGSGGGGSMADYKDIQMTQSPSSVSASVGDRVTITCRASQNVDSAVAWYQQKPGKAPKLLIYSASYRQSGVPSRFSGSGSGTDFTLTISSLQPEDFATYYCQQYYSTPWTFGQGTKVEIKREPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYC

SEQ ID NO: 1716 - protein, 531 aa, Artificial Sequence
  source: /note="Description of Artificial Sequence: Synthetic Chimeric Antigen Receptor sequence"
MALPVTALLLPLALLLHAARPEVQLVESGGGLVQPGRSLRLSCTASGFTFTDYYMSWVRQAPGKGLEWVGLIRSKADGYTTEYAASVKGRFTISRDDSKSIAYLQMNSLKTEDTAVYYCARDAAYYSYYSPEGAMDYWGQGTLVTVSSGGGGSGGGGSGGGGSMADYKDIQMTQSPSSVSASVGDRVTITCRASQNVDSAVAWYQQKPGKAPKLLIYSASYRYSGVPSRFSGSGSGTDFTLTISSLQPEDFATYYCQQYYSTPWTFGQGTKVEIKREPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYC

SEQ ID NO: 1717 - protein, 531 aa, Artificial Sequence
  source: /note="Description of Artificial Sequence: Synthetic Chimeric Antigen Receptor sequence"
MALPVTALLLPLALLLHAARPEVQLVESGGGLVQPGRSLRLSCTASGFTFTDYYMSWVRQAPGKGLEWVGLIRSKADGYTTEYAASVKGRFTISRDDSKSIAYLQMNSLKTEDTAVYYCARDAAYYSYYSPEGAMDYWGQGTLVTVSSGGGGSGGGGSGGGGSMADYKDIVMTQSPSSVSASVGDRVTITCRASQNVDSAVAWYQQKPGKAPKALIYSASYRYSGVPSRFSGRGSGTDFTLTISSLQPEDFATYYCQQYYSTPWTFGQGTKVEIKREPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYC

SEQ ID NO: 1718 - protein, 531 aa, Artificial Sequence
  source: /note="Description of Artificial Sequence: Synthetic Chimeric Antigen Receptor sequence"
MALPVTALLLPLALLLHAARPEVQLVESGGGLVQPGRSLRLSCTASGFTFTDYYMSWVRQAPGKGLEWVGLIRSKADGYTTEYSASVKGRFTISRDDSKSIAYLQMNSLKTEDTAVYYCARDAAYYSYYSPEGAMDYWGQGTLVTVSSGGGGSGGGGSGGGGSMADYKDIQMTQSPSSVSASVGDRVTITCRASQNVDSAVAWYQQKPGKAPKALIYSASYRYSGVPSRFSGRGSGTDFTLTISSLQPEDFATYYCQQYYSTPWTFGQGTKVEIKREPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYC

SEQ ID NO: 1719 - protein, 531 aa, Artificial Sequence
  source: /note="Description of Artificial Sequence: Synthetic Chimeric Antigen Receptor sequence"
MALPVTALLLPLALLLHAARPEVQLVESGGGLVQPGRSLRLSCTASGFTFTDYYMSWVRQAPGKGLEWVGLIRSKADGYTTEYSASVKGRFTISRDDSKSIAYLQMNSLKTEDTAVYYCARDAAYYSYYSPEGAMDYWGQGTLVTVSSGGGGSGGGGSGGGGSMADYKDIQMTQSPSSVSASVGDRVTITCRASQNVDSAVAWYQQKPGKAPKALIYSASYRYSGVPSRFSGSGSGTDFTLTISSLQPEDFATYYCQQYYSTPWTFGQGTKVEIKREPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYC

SEQ ID NO: 1720 - protein, 531 aa, Artificial Sequence
  source: /note="Description of Artificial Sequence: Synthetic Chimeric Antigen Receptor sequence"
MALPVTALLLPLALLLHAARPEVQLVESGGGLVQPGRSLRLSCTASGFTFTDYYMSWVRQAPGKGLEWVGLIRSKADGYTTEYSASVKGRFTISRDDSKSIAYLQMNSLKTEDTAVYYCARDAAYYSYYSPEGAMDYWGQGTLVTVSSGGGGSGGGGSGGGGSMADYKDIQMTQSPSSVSASVGDRVTITCRASQNVDSAVAWYQQKPGKAPKLLIYSASYGQSGVPSRFSGSGSGTDFTLTISSLQPEDFATYYCQQYYSTPWTFGQGTKVEIKREPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYC

SEQ ID NO: 1721 - protein, 531 aa, Artificial Sequence
  source: /note="Description of Artificial Sequence: Synthetic Chimeric Antigen Receptor sequence"
MALPVTALLLPLALLLHAARPEVQLVESGGGLVQPGRSLRLSCTASGFTFTDYYMSWVRQAPGKGLEWVGLIRSKADGYTTEYSASVKGRFTISRDDSKSIAYLQMNSLKTEDTAVYYCARDAAYYSYYSPEGAMDYWGQGTLVTVSSGGGGSGGGGSGGGGSMADYKDIQMTQSPSSVSASVGDRVTITCRASQNVDSAVAWYQQKPGKAPKLLIYSASYRQSGVPSRFSGSGSGTDFTLTISSLQPEDFATYYCQQYYSTPWTFGQGTKVEIKREPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYC

SEQ ID NO: 1722 - protein, 531 aa, Artificial Sequence
  source: /note="Description of Artificial Sequence: Synthetic Chimeric Antigen Receptor sequence"
MALPVTALLLPLALLLHAARPEVQLVESGGGLVQPGRSLRLSCTASGFTFTDYYMSWVRQAPGKGLEWVGLIRSKADGYTTEYSASVKGRFTISRDDSKSIAYLQMNSLKTEDTAVYYCARDAAYYSYYSPEGAMDYWGQGTLVTVSSGGGGSGGGGSGGGGSMADYKDIQMTQSPSSVSASVGDRVTITCRASQNVDSAVAWYQQKPGKAPKLLIYSASYRYSGVPSRFSGSGSGTDFTLTISSLQPEDFATYYCQQYYSTPWTFGQGTKVEIKREPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYC

SEQ ID NO: 1723 - protein, 531 aa, Artificial Sequence
  source: /note="Description of Artificial Sequence: Synthetic Chimeric Antigen Receptor sequence"
MALPVTALLLPLALLLHAARPEVQLVESGGGLVQPGRSLRLSCTASGFTFTDYYMSWVRQAPGKGLEWVGLIRSKADGYTTEYSASVKGRFTISRDDSKSIAYLQMNSLKTEDTAVYYCARDAAYYSYYSPEGAMDYWGQGTLVTVSSGGGGSGGGGSGGGGSMADYKDIVMTQSPSSVSASVGDRVTITCRASQNVDSAVAWYQQKPGKAPKALIYSASYRYSGVPSRFSGRGSGTDFTLTISSLQPEDFATYYCQQYYSTPWTFGQGTKVEIKREPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYC

SEQ ID NO: 1724 - protein, 531 aa, Artificial Sequence
  source: /note="Description of Artificial Sequence: Synthetic Chimeric Antigen Receptor sequence"
MALPVTALLLPLALLLHAARPEVQLVESGGGLVQPGRSLRLSCTASGFTFTDYYMSWVRQAPGKGLEWVGLIRSKADGYTTEYSASVKGRFTISRDDSKSILYLQMNSLKTEDTAVYYCARDAAYYSYYSPEGAMDYWGQGTLVTVSSGGGGSGGGGSGGGGSMADYKDIQMTQSPSSVSASVGDRVTITCRASQNVDSAVAWYQQKPGKAPKALIYSASYRYSGVPSRFSGRGSGTDFTLTISSLQPEDFATYYCQQYYSTPWTFGQGTKVEIKREPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYC

SEQ ID NO: 1725 - protein, 531 aa, Artificial Sequence
  source: /note="Description of Artificial Sequence: Synthetic Chimeric Antigen Receptor sequence"
MALPVTALLLPLALLLHAARPEVQLVESGGGLVQPGRSLRLSCTASGFTFTDYYMSWVRQAPGKGLEWVGLIRSKADGYTTEYSASVKGRFTISRDDSKSILYLQMNSLKTEDTAVYYCARDAAYYSYYSPEGAMDYWGQGTLVTVSSGGGGSGGGGSGGGGSMADYKDIQMTQSPSSVSASVGDRVTITCRASQNVDSAVAWYQQKPGKAPKALIYSASYRYSGVPSRFSGSGSGTDFTLTISSLQPEDFATYYCQQYYSTPWTFGQGTKVEIKREPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYC

SEQ ID NO: 1726 - protein, 531 aa, Artificial Sequence
  source: /note="Description of Artificial Sequence: Synthetic Chimeric Antigen Receptor sequence"
MALPVTALLLPLALLLHAARPEVQLVESGGGLVQPGRSLRLSCTASGFTFTDYYMSWVRQAPGKGLEWVGLIRSKADGYTTEYSASVKGRFTISRDDSKSILYLQMNSLKTEDTAVYYCARDAAYYSYYSPEGAMDYWGQGTLVTVSSGGGGSGGGGSGGGGSMADYKDIQMTQSPSSVSASVGDRVTITCRASQNVDSAVAWYQQKPGKAPKLLIYSASYGQSGVPSRFSGSGSGTDFTLTISSLQPEDFATYYCQQYYSTPWTFGQGTKVEIKREPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYC

SEQ ID NO: 1727 - protein, 531 aa, Artificial Sequence
  source: /note="Description of Artificial Sequence: Synthetic Chimeric Antigen Receptor sequence"
MALPVTALLLPLALLLHAARPEVQLVESGGGLVQPGRSLRLSCTASGFTFTDYYMSWVRQAPGKGLEWVGLIRSKADGYTTEYSASVKGRFTISRDDSKSILYLQMNSLKTEDTAVYYCARDAAYYSYYSPEGAMDYWGQGTLVTVSSGGGGSGGGGSGGGGSMADYKDIQMTQSPSSVSASVGDRVTITCRASQNVDSAVAWYQQKPGKAPKLLIYSASYRQSGVPSRFSGSGSGTDFTLTISSLQPEDFATYYCQQYYSTPWTFGQGTKVEIKREPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYC

SEQ ID NO: 1728 - protein, 531 aa, Artificial Sequence
  source: /note="Description of Artificial Sequence: Synthetic Chimeric Antigen Receptor sequence"
MALPVTALLLPLALLLHAARPEVQLVESGGGLVQPGRSLRLSCTASGFTFTDYYMSWVRQAPGKGLEWVGLIRSKADGYTTEYSASVKGRFTISRDDSKSILYLQMNSLKTEDTAVYYCARDAAYYSYYSPEGAMDYWGQGTLVTVSSGGGGSGGGGSGGGGSMADYKDIQMTQSPSSVSASVGDRVTITCRASQNVDSAVAWYQQKPGKAPKLLIYSASYRYSGVPSRFSGSGSGTDFTLTISSLQPEDFATYYCQQYYSTPWTFGQGTKVEIKREPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYC

SEQ ID NO: 1729 - protein, 531 aa, Artificial Sequence
  source: /note="Description of Artificial Sequence: Synthetic Chimeric Antigen Receptor sequence"
MALPVTALLLPLALLLHAARPEVQLVESGGGLVQPGRSLRLSCTASGFTFTDYYMSWVRQAPGKGLEWVGLIRSKADGYTTEYSASVKGRFTISRDDSKSILYLQMNSLKTEDTAVYYCARDAAYYSYYSPEGAMDYWGQGTLVTVSSGGGGSGGGGSGGGGSMADYKDIVMTQSPSSVSASVGDRVTITCRASQNVDSAVAWYQQKPGKAPKALIYSASYRYSGVPSRFSGRGSGTDFTLTISSLQPEDFATYYCQQYYSTPWTFGQGTKVEIKREPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYC

SEQ ID NO: 1730 - protein, 532 aa, Artificial Sequence
  source: /note="Description of Artificial Sequence: Synthetic Chimeric Antigen Receptor sequence"
MALPVTALLLPLALLLHAARPQIQLVQSGPELKKPGETVKISCKASGYIFTNYGMNWVKQAPGKSFKWMGWINTYTGESTYSADFKGRFAFSLETSASTAYLHINDLKNEDTATYFCARSGGYDPMDYWGQGTSVTVSSGGGGSGGGGSGGGGSDIVLTQSPASLAVSLGQRATISCRASESVDNYGNTFMHWYQQKPGQPPKLLIYRASNLESGIPARFSGSGSRTDFTLTINPVEADDVATYYCQQSNEDPPTFGAGTKLELKRSDPGSGGGGSCPYSNPSLCSGGGGSCPYSNPSLCSGGGGSAPTTTPAPRPPTPAPTIASQPLSLRPEACRPAAGGAVHTRGLDFACDIYIWAPLAGTCGVLLLSLVITLYCRRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRE

SEQ ID NO: 1731 - protein, 646 aa, Artificial Sequence
  source: /note="Description of Artificial Sequence: Synthetic Chimeric Antigen Receptor sequence"
QVQLQQPGAELVRPGASVKLSCKASGYTFTSYWMNWVKQRPDQGLEWIGRIDPYDSETHYNQKFKDKAILTVDKSSSTAYMQLSSLTSEDSAVYYCARGNWDDYWGQGTTLTVSSGGGGSGGGGSGGGGSDVQITQSPSYLAASPGETITINCRASKSISKDLAWYQEKPGKTNKLLIYSGSTLQSGIPSRFSGSGSGTDFTLTISSLEPEDFAMYYCQQHNKYPYTFGGGTKLEIKEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1732 - protein, 649 aa, Artificial Sequence
  source: /note="Description of Artificial Sequence: Synthetic Chimeric Antigen Receptor sequence"
QVQLQQPGAELVRPGASVKLSCKASGYTFTSYWMNWVKQRPDQGLEWIGRIDPYDSETHYNQKFKDKAILTVDKSSSTAYMQLSSLTSEDSAVYYCARGNWDDYWGQGTTLTVSSGGGGSGGGGSGGGGSDVQITQSPSYLAASPGETITINCRASKSISKDLAWYQEKPGKTNKLLIYSGSTLQSGIPSRFSGSGSGTDFTLTISSLEPEDFAMYYCQQHNKYPYTFGGGTKLEIKEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1733 - protein, 653 aa, Artificial Sequence
  source: /note="Description of Artificial Sequence: Synthetic Chimeric Antigen Receptor sequence"
QIQLVQSGPELKKPGETVKISCKASGYIFTNYGMNWVKQAPGKSFKWMGWINTYTGESTYSADFKGRFAFSLETSASTAYLHINDLKNEDTATYFCARSGGYDPMDYWGQGTSVTVSSGGGGSGGGGSGGGGSDIVLTQSPASLAVSLGQRATISCRASESVDNYGNTFMHWYQQKPGQPPKLLIYRASNLESGIPARFSGSGSRTDFTLTINPVEADDVATYYCQQSNEDPPTFGAGTKLELKEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1734 - protein, 656 aa, Artificial Sequence
  source: /note="Description of Artificial Sequence: Synthetic Chimeric Antigen Receptor sequence"
QIQLVQSGPELKKPGETVKISCKASGYIFTNYGMNWVKQAPGKSFKWMGWINTYTGESTYSADFKGRFAFSLETSASTAYLHINDLKNEDTATYFCARSGGYDPMDYWGQGTSVTVSSGGGGSGGGGSGGGGSDIVLTQSPASLAVSLGQRATISCRASESVDNYGNTFMHWYQQKPGQPPKLLIYRASNLESGIPARFSGSGSRTDFTLTINPVEADDVATYYCQQSNEDPPTFGAGTKLELKEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1735 - protein, 657 aa, Artificial Sequence
  source: /note="Description of Artificial Sequence: Synthetic Chimeric Antigen Receptor sequence"
EVQLVESGGGLVQPGRSLRLSCTASGFTFTDYYMSWVRQAPGKGLEWVGLIRSKADGYTTEYAASVKGRFTISRDDSQSIAYLQMNSLKTEDTAVYYCARDAAYYSYYSPEGAMDYGQGTLVTVSSGGGGSGGGGSGGGGSDIQMTQSPSSVSASVGDRVTITCKASQVDSAVAWYQQKPGKAPKALIYSASYRYSGVPDRFSGSGSGTDFTLTISSLQPEDLATYYCQQYYSTPWTFGQGTKVEIKREPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1736 - protein, 657 aa, Artificial Sequence
  source: /note="Description of Artificial Sequence: Synthetic Chimeric Antigen Receptor sequence"
EVQLVESGGGLVQPGRSLRLSCTASGFTFTDYYMSWVRQAPGKGLEWVGLIRSKADGYTTEYAASVKGRFTISRDDSQSIAYLQMNSLKTEDTAVYYCARDAAYYSYYSPEGAMDYGQGTLVTVSSGGGGSGGGGSGGGGSDIQMTQSPSSVSASVGDRVTITCRASQVDSAVAWYQQKPGKAPKALIYSASYRYSGVPSRFSGSGSGTDFTLTISSLQPEDFATYYCQQYYSTPWTFGQGTKVEIKREPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1737 - protein, 657 aa, Artificial Sequence
  source: /note="Description of Artificial Sequence: Synthetic Chimeric Antigen Receptor sequence"
EVQLVESGGGLVQPGRSLRLSCTASGFTFTDYYMSWVRQAPGKGLEWVGLIRSKADGYTTEYAASVKGRFTISRDDSQSIAYLQMNSLKTEDTAVYYCARDAAYYSYYSPEGAMDYGQGTLVTVSSGGGGSGGGGSGGGGSDIVMTQSPSSVSASVGDRVTITCRASQNVDSAVAYQQKPGKAPKALIYSASYRYSGVPSRFSGRGSGTDFTLTISSLQPEDFATYYCQQYYSTPWTFGQGTKVEIKREPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1738 - protein, 657 aa, Artificial Sequence
  source: /note="Description of Artificial Sequence: Synthetic Chimeric Antigen Receptor sequence"
EVQLVESGGGLVQPGRSLRLSCTASGFTFTDYYMSWVRQAPGKGLEWVGLIRSKADGYTTEYSASVKGRFTISRDDSKSILYLQMNSLKTEDTAVYYCARDAAYYSYYSPEGAMDYGQGTLVTVSSGGGGSGGGGSGGGGSDIQMTQSPSSVSASVGDRVTITCRASQVDSAVAWYQQKPGKAPKALIYSASYRYSGVPSRFSGSGSGTDFTLTISSLQPEDFATYYCQQYYSTPWTFGQGTKVEIKREPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1739 - protein, 657 aa, Artificial Sequence
  source: /note="Description of Artificial Sequence: Synthetic Chimeric Antigen Receptor sequence"
EVQLVESGGGLVQPGRSLRLSCTASGFTFTDYYMSWVRQAPGKGLEWVGLIRSKADGYTTEYSASVKGRFTISRDDSKSILYLQMNSLKTEDTAVYYCARDAAYYSYYSPEGAMDYWGQGTLVTVSSGGGGSGGGGSGGGGSDIVMTQSPSSVSASVGDRVTITCRASQNVDSAVAWYQQKPGKAPKALIYSASYRYSGVPSRFSGRGSGTDFTLTISSLQPEDFATYYCQQYYSTPWTFGQGTKVEIKREPKSPDKTHTCPPCPAPPVAGPSVFLFPPKPKDTLMIARTPEVTCWVDVSHEDPEVKFNWYVDGVEVHNAKTKPREEQYNSTYRWSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1740 - protein, 657 aa, Artificial Sequence
  source: /note="Description of Artificial Sequence: Synthetic Chimeric Antigen Receptor sequence"
EVQLVESGGGLVQPGRSLRLSCTASGFTFTDYYMSWVRQAPGKGLEWVGLIRSKADGYTTEYSASVKGRFTISRDDSQSIAYLQMNSLKTEDTAVYYCARDAAYYSYYSPEGAMDYGQGTLVTVSSGGGGSGGGGSGGGGSDIQMTQSPSSVSASVGDRVTITCKASQVDSAVAWYQQKPGKAPKLLIYSASYRYSGVPSRFSGSGSGTDFTLTISSLQPEDFATYYCQQYYSTPWTFGQGTKVEIKREPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1741 - protein, 657 aa, Artificial Sequence
  source: /note="Description of Artificial Sequence: Synthetic Chimeric Antigen Receptor sequence"
EVQLVESGGGLVQPGRSLRLSCTASGFTFTDYYMSWVRQAPGKGLEWVGLIRSKADGYTTEYSASVKGRFTISRDDSQSIAYLQMNSLKTEDTAVYYCARDAAYYSYYSPEGAMDYGQGTLVTVSSGGGGSGGGGSGGGGSDIQMTQSPSSVSASVGDRVTITCRASQVDSAVAWYQQKPGKAPKALIYSASYRYSGVPSRFSGSGSGTDFTLTISSLQPEDFATYYCQQYYSTPWTFGQGTKVEIKREPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1742 - protein, 657 aa, Artificial Sequence
  source: /note="Description of Artificial Sequence: Synthetic Chimeric Antigen Receptor sequence"
EVQLVESGGGLVQPGRSLRLSCTASGFTFTDYYMSWVRQAPGKGLEWVGLIRSKADGYTTEYSASVKGRFTISRDDSQSIAYLQMNSLKTEDTAVYYCARDAAYYSYYSPEGAMDYGQGTLVTVSSGGGGSGGGGSGGGGSDIQMTQSPSSVSASVGDRVTITCRASQVDSAVAWYQQKPGKAPKALIYSASYRYSGVPSRFSGSGSGTDFTLTISSLQPEDLATYYCQQYYSTPWTFGQGTKVEIKREPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1743 - protein, 664 aa, Artificial Sequence
  source: /note="Description of Artificial Sequence: Synthetic Chimeric Antigen Receptor sequence"
EVKLVESGGGLVQPGGSLSLSCAASGFTFTDYYMSWVRQPPGKALEWLALIRSKADGYTTEYSASVKGRFTLSRDDSQSILYLQMNALRPEDSATYYCARDAAYYSYYSPEGAMDYWGQGTSVTVSSGGGGSGGGGSGGGGSMADYKDIVMTQSHKFMSTSVGDRVNITCKASQNVDSAVAWYQQKPGQSPKALIYSASYRYSGVPDRFTGRGSGTDFTLTISSVQAEDLAVYYCQQYYSTPWTFGGGTKLEIKREPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1744 - protein, 667 aa, Artificial Sequence
  source: /note="Description of Artificial Sequence: Synthetic Chimeric Antigen Receptor sequence"
EVKLVESGGGLVQPGGSLSLSCAASGFTFTDYYMSWVRQPPGKALEWLALIRSKADGYTTEYSASVKGRFTLSRDDSQSILYLQMNALRPEDSATYYCARDAAYYSYYSPEGAMDYWGQGTSVTVSSGGGGSGGGGSGGGGSMADYKDIVMTQSHKFMSTSVGDRVNITCKASQNVDSAVAWYQQKPGQSPKALIYSASYRYSGVPDRFTGRGSGTDFTLTISSVQAEDLAVYYCQQYYSTPWTFGGGTKLEIKREPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1745 - protein, 672 aa, Artificial Sequence
  source: /note="Description of Artificial Sequence: Synthetic Chimeric Antigen Receptor sequence"
MLLLVTSLLLCELPHPAFLLIPQVQLQQPGAELVRPGASVKLSCKASGYTFTSYWMNWVKQRPDQGLEWIGRIDPYDSETHYNQKFKDKAILTVDKSSSTAYMQLSSLTSEDSAVYYCARGNWDDYWGQGTTLTVSSGGGGSGGGGSGGGGSDVQITQSPSYLAASPGETITINCRASKSISKDLAWYQEKPGKTNKLLIYSGSTLQSGIPSRFSGSGSGTDFTLTISSLEPEDFAMYYCQQHNKYPYTFGGGTKLEIKESKYGPPCPPCPAPEFEGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKMFWVLVVVGGVLACYSLLVTVAFIIFWVRSKRSRGGHSDYMNMTPRRPGPTRKHYQPYAPPRDFAAYRSGGGRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1746 - protein, 672 aa, Artificial Sequence
  source: /note="Description of Artificial Sequence: Synthetic Chimeric Antigen Receptor sequence"
MLLLVTSLLLCELPHPAFLLIPQVQLQQPGAELVRPGASVKLSCKASGYTFTSYWMNWVKQRPDQGLEWIGRIDPYDSETHYNQKFKDKAILTVDKSSSTAYMQLSSLTSEDSAVYYCARGNWDDYWGQGTTLTVSSGGGGSGGGGSGGGGSDVQITQSPSYLAASPGETITINCRASKSISKDLAWYQEKPGKTNKLLIYSGSTLQSGIPSRFSGSGSGTDFTLTISSLEPEDFAMYYCQQHNKYPYTFGGGTKLEIKESKYGPPCPPCPAPEFEGGPSVFLFPPKPKDTLMISRTPEVTCVVVDVSQEDPEVQFNWYVDGVEVHNAKTKPREEQFQSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKMFWVLVVVGGVLACYSLLVTVAFIIFWVRSKRSRGGHSDYMNMTPRRPGPTRKHYQPYAPPRDFAAYRSGGGRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1747 - protein, 679 aa, Artificial Sequence
  source: /note="Description of Artificial Sequence: Synthetic Chimeric Antigen Receptor sequence"
MLLLVTSLLLCELPHPAFLLIPQIQLVQSGPELKKPGETVKISCKASGYIFTNYGMNWVKQAPGKSFKWMGWINTYTGESTYSADFKGRFAFSLETSASTAYLHINDLKNEDTATYFCARSGGYDPMDYWGQGTSVTVSSGGGGSGGGGSGGGGSDIVLTQSPASLAVSLGQRATISCRASESVDNYGNTFMHWYQQKPGQPPKLLIYRASNLESGIPARFSGSGSRTDFTLTINPVEADDVATYYCQQSNEDPPTFGAGTKLELKESKYGPPCPPCPAPEFEGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKMFWVLVVVGGVLACYSLLVTVAFIIFWVRSKRSRGGHSDYMNMTPRRPGPTRKHYQPYAPPRDFAAYRSGGGRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1748 - protein, 679 aa, Artificial Sequence
  source: /note="Description of Artificial Sequence: Synthetic Chimeric Antigen Receptor sequence"
MLLLVTSLLLCELPHPAFLLIPQIQLVQSGPELKKPGETVKISCKASGYIFTNYGMNWVKQAPGKSFKWMGWINTYTGESTYSADFKGRFAFSLETSASTAYLHINDLKNEDTATYFCARSGGYDPMDYWGQGTSVTVSSGGGGSGGGGSGGGGSDIVLTQSPASLAVSLGQRATISCRASESVDNYGNTFMHWYQQKPGQPPKLLIYRASNLESGIPARFSGSGSRTDFTLTINPVEADDVATYYCQQSNEDPPTFGAGTKLELKESKYGPPCPPCPAPEFEGGPSVFLFPPKPKDTLMISRTPEVTCVVVDVSQEDPEVQFNWYVDGVEVHNAKTKPREEQFQSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKMFWVLVVVGGVLACYSLLVTVAFIIFWVRSKRSRGGHSDYMNMTPRRPGPTRKHYQPYAPPRDFAAYRSGGGRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1749 - protein, 685 aa, Artificial Sequence
  source: /note="Description of Artificial Sequence: Synthetic Chimeric Antigen Receptor sequence"
MALPVTALLLPLALLLHAARPEVKLVESGGGLVQPGGSLSLSCAASGFTFTDYYMSWVRQPPGKALEWLALIRSKADGYTTEYSASVKGRFTLSRDDSQSILYLQMNALRPEDSATYYCARDAAYYSYYSPEGAMDYWGQGTSVTVSSGGGGSGGGGSGGGGSMADYKDIVMTQSHKFMSTSVGDRVNITCKASQNVDSAVAWYQQKPGQSPKALIYSASYRYSGVPDRFTGRGSGTDFTLTISSVQAEDLAVYYCQQYYSTPWTFGGGTKLEIKREPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1750 - protein, 699 aa, Artificial Sequence
  source: /note="Description of Artificial Sequence: Synthetic Chimeric Antigen Receptor sequence"
MGWSWIFLFLVSGTGGVLSEVQLQQSGPELVKPGASVKMSCKASGYTFTDYYMKWVKQSHGKSLEWIGDIIPSNGATFYNQKFKGKATLTVDRSSSTAYMHLNSLTSEDSAVYYCTRSHLLRASWFAYWGQGTLVTVSAASGGGGSGGGGSGGGGSMESQTQVLMSLLFWVSGTCGDFVMTQSPSSLTVTAGEKVTMSCKSSQSLLNSGNQKNYLTWYLQKPGQPPKLLIYWASTRESGVPDRFTGSGSGTDFTLTISSVQAEDLAVYYCQNDYSYPYTFGGGTKLEIKREPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1751 - protein, 702 aa, Artificial Sequence
  source: /note="Description of Artificial Sequence: Synthetic Chimeric Antigen Receptor sequence"
MGWSWIFLFLVSGTGGVLSEVQLQQSGPELVKPGASVKMSCKASGYTFTDYYMKWVKQSHGKSLEWIGDIIPSNGATFYNQKFKGKATLTVDRSSSTAYMHLNSLTSEDSAVYYCTRSHLLRASWFAYWGQGTLVTVSAASGGGGSGGGGSGGGGSMESQTQVLMSLLFWVSGTCGDFVMTQSPSSLTVTAGEKVTMSCKSSQSLLNSGNQKNYLTWYLQKPGQPPKLLIYWASTRESGVPDRFTGSGSGTDFTLTISSVQAEDLAVYYCQNDYSYPYTFGGGTKLEIKREPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1752 - protein, 487 aa, Artificial Sequence
  source: /note="Description of Artificial Sequence: Synthetic Chimeric Antigen Receptor sequence"
MALPVTALLLPLALLLHAARPQVQLVQSGAEVKKPGASVKVSCKASGYTFTGYYMHWVRQAPGQGLEWMGWINPNSGGTNYAQKFQGRVTMTRDTSISTAYMELSRLRSDDTAVYYCARDMNILATVPFDIWGQGTMVTVSSGGGGSGGGGSGGGGSDIQMTQSPSSLSASVGDRVTITCRASQSISTYLNWYQQKPGKAPNLLIYAAFSLQSGVPSRFSGSGSGTDFTLTINSLQPEDFATYYCQQGDSVPLTFGGGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1753 - protein, 487 aa, Artificial Sequence
  source: /note="Description of Artificial Sequence: Synthetic Chimeric Antigen Receptor sequence"
MALPVTALLLPLALLLHAARPQVQLVQSGAEVKKPGASVKVSCKASGYTFTGYYMHWVRQAPGQGLEWMGWINPNSGGTNYAQKFQGRVTLTRDTSISTVYMELSRLRSDDTAVYYCARDMNILATVPFDIWGQGTMVTVSSGGGGSGGGGSGGGGSDIQMTQSPSSLSASVGDRVTITCRASQSISSYLNWYQQKPGKAPKLLIYAASSLQSGVPSRFSGSGSGTDFTLTVNSLQPEDFATYYCQQGDSVPLTFGGGTRLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1754 - protein, 487 aa, Artificial Sequence
  source: /note="Description of Artificial Sequence: Synthetic Chimeric Antigen Receptor sequence"
MALPVTALLLPLALLLHAARPQVQLVQSGAEVKKPGASVKVSCKASGYIFTGYYIHWVRQAPGQGLEWMGWINPNSGGTNYAQKFQGRVTMTRDTSISTAYMELSGLRSDDPAVYYCARDMNILATVPFDIWGQGTLVTVSSGGGGSGGGGSGGGGSDIQLTQSPSSLSASVGDRVTITCRASQSISSYLNWYQQKPGKAPKLLIYAASSLQSGVPSRFSGSGSGTDFTLTVNSLQPEDFATYYCQQGDSVPLTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1755 - protein, 336 aa, Artificial Sequence
  source: /note="Description of Artificial Sequence: Synthetic Chimeric Antigen Receptor sequence"
MALPVTALLLPLALLLHAARPQVQLQQSGAEVKKSGASVKVSCKASGYTFTDYYMHWLRQAPGQGLEWMGWINPNSGDTNYAQKFQGRVTLTRDTSISTVYMELSRLRSDDTAVYYCARDMNILATVPFDIWGQGTMVTVSSASGGGGSGGRASGGGGSDIQMTQSPSSLSASVGDRVTITCRASQSISSYLNWYQQKPGKAPKLLIYAASSLQSGVPSRFSGSGSGTDFTLTISSLQPEDFATYYCQQGDSVPLTFGGGTKVEIKTTTPAPRPPTPAPTIASQPLSLRPEACRPAAGGAVHTRGLDFACDIYIWAPLAGTCGVLLLSLVITLYCK

SEQ ID NO: 1756 - protein, 486 aa, Artificial Sequence
  source: /note="Description of Artificial Sequence: Synthetic Chimeric Antigen Receptor sequence"
MALPVTALLLPLALLLHAARPEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYSSSLKSRVTISKDNSKNQVSLKLSSVTAADTAVYYCAKHYYYGGSYAMDYWGQGTLVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1757 - protein, 486 aa, Artificial Sequence
  source: /note="Description of Artificial Sequence: Synthetic Chimeric Antigen Receptor sequence"
MALPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1758 - protein, 276 aa, Artificial Sequence
  source: /note="Description of Artificial Sequence: Synthetic polypeptide"
MALPVTALLLPLALLLHAARPEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSGGGGSQVQLQESGPGLVKPSETLSLTCTVSGVSLPDYGVSWIRQPPGKGLEWIGVIWGSETTYYNSSLKSRVTISKDNSKNQVSLKLSSVTAADTAVYYCAKHYYYGGSYAMDYWGQGTLVTVSSHHHHHHHH

SEQ ID NO: 1759 - protein, 276 aa, Artificial Sequence
  source: /note="Description of Artificial Sequence: Synthetic polypeptide"
MALPVTALLLPLALLLHAARPQVQLQESGPGLVKPSETLSLTCTVSGVSLPDYGVSWIRQPPGKGLEWIGVIWGSETTYYNSSLKSRVTISKDNSKNQVSLKLSSVTAADTAVYYCAKHYYYGGSYAMDYWGQGTLVTVSSGGGGSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKHHHHHHHH

SEQ ID NO: 1760 - protein, 276 aa, Artificial Sequence
  source: /note="Description of Artificial Sequence: Synthetic polypeptide"
MALPVTALLLPLALLLHAARPQVQLQESGPGLVKPSETLSLTCTVSGVSLPDYGVSWIRQPPGKGLEWIGVIWGSETTYYSSSLKSRVTISKDNSKNQVSLKLSSVTAADTAVYYCAKHYYYGGSYAMDYWGQGTLVTVSSGGGGSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKHHHHHHHH

SEQ ID NO: 1761 - protein, 276 aa, Artificial Sequence
  source: /note="Description of Artificial Sequence: Synthetic polypeptide"
MALPVTALLLPLALLLHAARPQVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSSGGGGSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKHHHHHHHH

SEQ ID NO: 1762 - protein, 271 aa, Artificial Sequence
  source: /note="Description of Artificial Sequence: Synthetic polypeptide"
MALPVTALLLPLALLLHAARPEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYNSSLKSRVTISKDNSKNQVSLKLSSVTAADTAVYYCAKHYYYGGSYAMDYWGQGTLVTVSSHHHHHHHH

SEQ ID NO: 1763 - protein, 271 aa, Artificial Sequence
  source: /note="Description of Artificial Sequence: Synthetic polypeptide"
MALPVTALLLPLALLLHAARPQVQLQESGPGLVKPSETLSLTCTVSGVSLPDYGVSWIRQPPGKGLEWIGVIWGSETTYYNSSLKSRVTISKDNSKNQVSLKLSSVTAADTAVYYCAKHYYYGGSYAMDYWGQGTLVTVSSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKHHHHHHHH

SEQ ID NO: 1764 - protein, 276 aa, Artificial Sequence
  source: /note="Description of Artificial Sequence: Synthetic polypeptide"
MALPVTALLLPLALLLHAARPEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSGGGGSQVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSSHHHHHHHH

SEQ ID NO: 1765 - protein, 144 aa, Artificial Sequence
  source: /note="Description of Artificial Sequence: Synthetic Chimeric Antigen Receptor sequence"
MALPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSE

SEQ ID NO: 1766 - protein, 246 aa, Artificial Sequence
  source: /note="Description of Artificial Sequence: Synthetic polypeptide"
DIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGSTSGSGKPGSGEGSTKGEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSE

SEQ ID NO: 1767 - protein, 248 aa, Artificial Sequence
  source: /note="Description of Artificial Sequence: Synthetic Chimeric Antigen Receptor sequence"
DIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITKAGGGGSGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVS

SEQ ID NO: 1768 - protein, 251 aa, Artificial Sequence; identical to SEQ ID NO: 219
  source: /note="Description of Artificial Sequence: Synthetic Chimeric Antigen Receptor sequence"

SEQ ID NO: 1769 - protein, 254 aa, Artificial Sequence
  source: /note="Description of Artificial Sequence: Synthetic Chimeric Antigen Receptor sequence"
RCDIQMTQSPSSLSASVGDRVTITCRASEDIYFNLVWYQQKPGKAPKLLIYDTNRLADGVPSRFSGSGSGTQYTLTISSLQPEDFATYYCQHYKNYPLTFGQGTKLEIKRSGGGGSGGGGSGGGGSGGGGSRSEVQLVESGGGLVQPGGSLRLSCAASGFTLSNYGMHWIRQAPGKGLEWVSSISLNGGSTYYRDSVKGRFTISRDNAKSTLYLQMNSLRAEDTAVYYCAAQDAYTGGYFDYWGQGTLVTVSSM

SEQ ID NO: 1770 - protein, 428 aa, Artificial Sequence
  source: /note="Description of Artificial Sequence: Synthetic Chimeric Antigen Receptor sequence"
MALPVTALLLPLALLLHAARPEIVLTQSPGTLSLSPGERATLSCRASQSVSSSYLAWYQQKPGQAPRLLIYGASSRATGIPDRFSGSGSGTDFTLTISRLEPEDFAVYYCQQYGSSRFTFGPGTKVDIKGSTSGSGKPGSGEGSTKGQVQLVQSGAEVKKPGSSVKVSCKDSGGTFSSYAISWVRQAPGQGLEWMGGIIPIFGTTNYAQQFQGRVTITADESTSTAYMELSSLRSEDTAVYYCAREAVAADWLDPWGQGTLVTVSSFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSQVRKAAITSYEKSDGVYTGLSTRNQETYETLKHEKPPQ

SEQ ID NO: 1771 - protein, 432 aa, Artificial Sequence
  source: /note="Description of Artificial Sequence: Synthetic Chimeric Antigen Receptor sequence"
MLLLVTSLLLCELPHPAFLLIPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGSTSGSGKPGSGEGSTKGEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSAAAFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSQVRKAAITSYEKSDGVYTGLSTRNQETYETLKHEKPPQ

SEQ ID NO: 1772 - protein, 465 aa, Artificial Sequence
  source: /note="Description of Artificial Sequence: Synthetic polypeptide"
DIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1773 - protein, 465 aa, Artificial Sequence
  source: /note="Description of Artificial Sequence: Synthetic Chimeric Antigen Receptor sequence"
MGTSLLCWMALCLLGADHADAQVQLQQSGPELVKPGASVKISCKASGYAFSSSWMNWVKQRPGKGLEWIGRIYPGDEDTNYSGKFKDKATLTADKSSTTAYMQLSSLTSEDSAVYFCARSLLYGDYLDYWGQGTTLTVSSGGGGSGGGGSGGGGSQIVLTQSPAIMSASPGEKVTMTCSASSSVSYMHWYQQKSGTSPKRWIYDTSKLASGVPDRFSGSGSGTSYFLTINNMEAEDAATYYCQQWNINPLTFGAGTKLELKRSDPAEPKSPDKTHTCPPCPKDPKFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1774 - protein, 467 aa, Artificial Sequence
  source: /note="Description of Artificial Sequence: Synthetic polypeptide"
DIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGSTSGSGKPGSGEGSTKGEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSAAAIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1775 - protein, 476 aa, Artificial Sequence
  source: /note="Description of Artificial Sequence: Synthetic Chimeric Antigen Receptor sequence"
MALPVTALLLPLALLLHAARPEIVLTQSPGTLSLSPGERATLSCRASQSVSSSYLAWYQQKPGQAPRLLIYGASSRATGIPDRFSGSGSGTDFTLTISRLEPEDFAVYYCQQYGSSRFTFGPGTKVDIKGSTSGSGKPGSGEGSTKGQVQLVQSGAEVKKPGSSVKVSCKDSGGTFSSYAISWVRQAPGQGLEWMGGIIPIFGTTNYAQQFQGRVTITADESTSTAYMELSSLRSEDTAVYYCAREAVAADWLDPWGQGTLVTVSSFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSQRRKYRSNKGESPVEPAEPCRYSCPREEEGSTIPIQEDYRKPEPACSPQVRKAAITSYEKSDGVYTGLSTRNQETYETLKHEKPPQ

SEQ ID NO: 1776 - protein, 476 aa, Artificial Sequence
  source: /note="Description of Artificial Sequence: Synthetic Chimeric Antigen Receptor sequence"
MLLLVTSLLLCELPHPAFLLIPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGSTSGSGKPGSGEGSTKGEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSESKYGPPCPPCPMFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRLEGGGEGRGSLLTCG

SEQ ID NO: 1777 - protein, 480 aa, Artificial Sequence
  source: /note="Description of Artificial Sequence: Synthetic Chimeric Antigen Receptor sequence"
MLLLVTSLLLCELPHPAFLLIPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGSTSGSGKPGSGEGSTKGEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSAAAFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSQRRKYRSNKGESPVEPAEPCRYSCPREEEGSTIPIQEDYRKPEPACSPQVRKAAITSYEKSDGVYTGLSTRNQETYETLKHEKPPQ

SEQ ID NO: 1778 - protein, 484 aa, Artificial Sequence
  source: /note="Description of Artificial Sequence: Synthetic Chimeric Antigen Receptor sequence"
MALPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSTTTPAPRPPTPAPTIASQPLSLRPEACRPAAGGAVHTRGLDFACDMWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1779 - protein, 486 aa, Artificial Sequence
  source: /note="Description of Artificial Sequence: Synthetic Chimeric Antigen Receptor sequence"
MALPVTALLLPLALLLHAARPEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1780 - protein, 486 aa, Artificial Sequence
  source: /note="Description of Artificial Sequence: Synthetic Chimeric Antigen Receptor sequence"
MALPVTALLLPLALLLHAARPQVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1781 - protein, 489 aa, Artificial Sequence
  source: /note="Description of Artificial Sequence: Synthetic Chimeric Antigen Receptor sequence"
MALPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSTRTTTPAPRPPTPAPTIASQPLSLRPEACRPAAGGAVHTRGLDFACDIYIWAPLAGTCGVLLLSLVITLYCAVSLSKMLKKRSPLTTGVYVKMPPTEPECEKQFQPYFIPINSARVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1782 - protein, 491 aa, Artificial Sequence
  source: /note="Description of Artificial Sequence: Synthetic Chimeric Antigen Receptor sequence"
MALPVTALLLPLALLLHAARPEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSGGGGSQVQLQESGPGLVKPSETLSLTCTVSGVSLPDYGVSWIRQPPGKGLEWIGVIWGSETTYYNSSLKSRVTISKDNSKNQVSLKLSSVTAADTAVYYCAKHYYYGGSYAMDYWGQGTLVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1783 - protein, 494 aa, Artificial Sequence
  source: /note="Description of Artificial Sequence: Synthetic Chimeric Antigen Receptor sequence"
METDTLLLWVLLLWVPGSTGDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITKAGGGGSGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSDPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1784 - protein, 495 aa, Artificial Sequence
  source: /note="Description of Artificial Sequence: Synthetic Chimeric Antigen Receptor sequence"
MALPVTALLLPLALLLHAARPEVQLQQSGPELIKPGASVKMSCKASGYTFTSYVMHWVKQKPGQGLEWIGYINPYNDGTKYNEKFKGKATLTSDKSSSTAYMELSSLTSEDSAVYYCARGTYYYGSRVFDYWGQGTTLTVSSGGGGSGGGGSGGGGSDIVMTQAAPSIPVTPGESVSISCRSSKSLLNSNGNTYLYWFLQRPGQSPQLLIYRMSNLASGVPDRFSGSGSGTAFTLRISRVEAEDVGVYYCMQHLEYPFTFGAGTKLELKRADTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1785 - protein, 495 aa, Artificial Sequence; identical to SEQ ID NO: 244
  source: /note="Description of Artificial Sequence: Synthetic Chimeric Antigen Receptor sequence"

SEQ ID NO: 1786 - protein, 502 aa, Artificial Sequence
  source: /note="Description of Artificial Sequence: Synthetic Chimeric Antigen Receptor sequence"
MALPVTALLLPLALLLHAARPEIVLTQSPGTLSLSPGERATLSCRASQSVSSSYLAWYQQKPGQAPRLLIYGASSRATGIPDRFSGSGSGTDFTLTISRLEPEDFAVYYCQQYGSSRFTFGPGTKVDIKGSTSGSGKPGSGEGSTKGQVQLVQSGAEVKKPGSSVKVSCKDSGGTFSSYAISWVRQAPGQGLEWMGGIIPIFGTTNYAQQFQGRVTITADESTSTAYMELSSLRSEDTAVYYCAREAVAADWLDPWGQGTLVTVSSFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1787 - protein, 506 aa, Artificial Sequence
  source: /note="Description of Artificial Sequence: Synthetic Chimeric Antigen Receptor sequence"
MLLLVTSLLLCELPHPAFLLIPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGSTSGSGKPGSGEGSTKGEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSAAAFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1788 - protein, 508 aa, Artificial Sequence
  source: /note="Description of Artificial Sequence: Synthetic Chimeric Antigen Receptor sequence"
MALPVTALLLPLALLLHAARPEIVLTQSPGTLSLSPGERATLSCRASQSVSSSYLAWYQQKPGQAPRLLIYGASSRATGIPDRFSGSGSGTDFTLTISRLEPEDFAVYYCQQYGSSRFTFGPGTKVDIKGSTSGSGKPGSGEGSTKGQVQLVQSGAEVKKPGSSVKVSCKDSGGTFSSYAISWVRQAPGQGLEWMGGIIPIFGTTNYAQQFQGRVTITADESTSTAYMELSSLRSEDTAVYYCAREAVAADWLDPWGQGTLVTVSSFVPVFLPAKPTTTPAPRPPTPAPTIASQPLSLRPEACRPAAGGAVHTRGLDFACDIYIWAPLAGTCGVLLLSLVITLYCNHRNRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1789 - protein, 508 aa, Artificial Sequence
  source: /note="Description of Artificial Sequence: Synthetic Chimeric Antigen Receptor sequence"
MALPVTALLLPLALLLHAARPEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYSSSLKSRVTISKDNSKNQVSLKLSSVTAADTAVYYCAKHYYYGGSYAMDYWGQGTLVTVSSTTTPAPRPPTPAPTIASQPLSLRPEACRPAAGGAVHTRGLDFACDIYIWAPLAGTCGVLLLSLVITLYCALYLLRRDQRLPPDAHKPPGGGSFRTPIQEEQADAHSTLAKIRSKRSRLLHSDYMNMTPRRPGPTRKHYQPYAPPRDFAAYRSILWHEMWHEGLIEASRLYFGERNVKGMFEVLEPLHAMMERGPQTLKETSFNQAYGRDLMEAQEWCRKYMKSGNVKDLLQAWDLYYHVFRRISK

SEQ ID NO: 1790 - protein, 508 aa, Artificial Sequence
  source: /note="Description of Artificial Sequence: Synthetic Chimeric Antigen Receptor sequence"
MALPVTALLLPLALLLHAARPEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYSSSLKSRVTISKDNSKNQVSLKLSSVTAADTAVYYCAKHYYYGGSYAMDYWGQGTLVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRSKRSRLLHSDYMNMTPRRPGPTRKHYQPYAPPRDFAAYRSILWHEMWHEGLIEASRLYFGERNVKGMFEVLEPLHAMMERGPQTLKETSFNQAYGRDLMEAQEWCRKYMKSGNVKDLLQAWDLYYHVFRRISK

SEQ ID NO: 1791 - protein, 509 aa, Artificial Sequence
  source: /note="Description of Artificial Sequence: Synthetic Chimeric Antigen Receptor sequence"
MALPVTALLLPLALLLHAARPEIVLTQSPGTLSLSPGERATLSCRASQSVSSSYLAWYQQKPGQAPRLLIYGASSRATGIPDRFSGSGSGTDFTLTISRLEPEDFAVYYCQQYGSSRFTFGPGTKVDIKGSTSGSGKPGSGEGSTKGQVQLVQSGAEVKKPGSSVKVSCKDSGGTFSSYAISWVRQAPGQGLEWMGGIIPIFGTTNYAQQFQGRVTITADESTSTAYMELSSLRSEDTAVYYCAREAVAADWLDPWGQGTLVTVSSFVPVFLPAKPTTTPAPRPPTPAPTIASQPLSLRPEACRPAAGGAVHTRGLDFACDIYIWAPLAGTCGVLLLSLVITLYCNHRNQRRKYRSNKGESPVEPAEPCRYSCPREEEGSTIPIQEDYRKPEPACSPRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1792 - protein, 513 aa, Artificial Sequence
  source: /note="Description of Artificial Sequence: Synthetic Chimeric Antigen Receptor sequence"
MLLLVTSLLLCELPHPAFLLIPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGSTSGSGKPGSGEGSTKGEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSAAAFVPVFLPAKPTTTPAPRPPTPAPTIASQPLSLRPEACRPAAGGAVHTRGLDFACDIYIWAPLAGTCGVLLLSLVITLYCNHRNQRRKYRSNKGESPVEPAEPCRYSCPREEEGSTIPIQEDYRKPEPACSPRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1793 - protein, 514 aa, Artificial Sequence
  source: /note="Description of Artificial Sequence: Synthetic Chimeric Antigen Receptor sequence"
MALPVTALLLPLALLLHAARPEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYSSSLKSRVTISKDNSKNQVSLKLSSVTAADTAVYYCAKHYYYGGSYAMDYWGQGTLVTVSSTTTPAPRPPTPAPTIASQPLSLRPEACRPAAGGAVHTRGLDFACDIYIWAPLAGTCGVLLLSLVITLYCQRRKYRSNKGESPVEPAEPCHYSCPREEEGSTIPIQEDYRKPEPACSPRSKRSRLLHSDYMNMTPRRPGPTRKHYQPYAPPRDFAAYRSILWHEMWHEGLIEASRLYFGERNVKGMFEVLEPLHAMMERGPQTLKETSFNQAYGRDLMEAQEWCRKYMKSGNVKDLLQAWDLYYHVFRRISK

SEQ ID NO: 1794 - protein, 522 aa, Artificial Sequence
  source: /note="Description of Artificial Sequence: Synthetic Chimeric Antigen Receptor sequence"
MALPVTALLLPLALLLHAARPEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYSSSLKSRVTISKDNSKNQVSLKLSSVTAADTAVYYCAKHYYYGGSYAMDYWGQGTLVTVSSTTTPAPRPPTPAPTIASQPLSLRPEACRPAAGGAVHTRGLDFACDIYIWAPLAGTCGVLLLSLVITLYCALYLLRRDQRLPPDAHKPPGGGSFRTPIQEEQADAHSTLAKIRSKRSRLLHSDYMNMTPRRPGPTRKHYQPYAPPRDFAAYRSGVQVETISPGDGRTFPKRGQTCVVHYTGMLEDGKKFDSSRDRNKPFKFMLGKQEVIRGWEEGVAQMSVGQRAKLTISPDYAYGATGHPGIIPPHATLVFDVELLKLE

SEQ ID NO: 1795 - protein, 522 aa, Artificial Sequence
  source: /note="Description of Artificial Sequence: Synthetic Chimeric Antigen Receptor sequence"
MALPVTALLLPLALLLHAARPEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYSSSLKSRVTISKDNSKNQVSLKLSSVTAADTAVYYCAKHYYYGGSYAMDYWGQGTLVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRSKRSRLLHSDYMNMTPRRPGPTRKHYQPYAPPRDFAAYRSGVQVETISPGDGRTFPKRGQTCVVHYTGMLEDGKKFDSSRDRNKPFKFMLGKQEVIRGWEEGVAQMSVGQRAKLTISPDYAYGATGHPGIIPPHATLVFDVELLKLE

SEQ ID NO: 1796 - protein, 527 aa, Artificial Sequence
  source: /note="Description of Artificial Sequence: Synthetic Chimeric Antigen Receptor sequence"
DIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGSTSGSGKPGSGEGSTKGEVKLQESGPGLVAPSQSLSVTCTVSGVSLPDYGVSWIRQPPRKGLEWLGVRWGSETTYYNSALKSRLTIIKDNSKSQVFLKMNSLQTDDTAIYYCAKHYYYGGSYAMDYWGQGTSVTVSSAAIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSASGGGGSGGGGSKSRQTPPLASVEMEAMEALPVTWGTSSRDEDLENCSHHLGGGGSGGGGSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1797 - protein, 528 aa, Artificial Sequence
  source: /note="Description of Artificial Sequence: Synthetic Chimeric Antigen Receptor sequence"
MALPVTALLLPLALLLHAARPEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYSSSLKSRVTISKDNSKNQVSLKLSSVTAADTAVYYCAKHYYYGGSYAMDYWGQGTLVTVSSTTTPAPRPPTPAPTIASQPLSLRPEACRPAAGGAVHTRGLDFACDIYIWAPLAGTCGVLLLSLVITLYCQRRKYRSNKGESPVEPAEPCHYSCPREEEGSTIPIQEDYRKPEPACSPRSKRSRLLHSDYMNMTPRRPGPTRKHYQPYAPPRDFAAYRSGVQVETISPGDGRTFPKRGQTCVVHYTGMLEDGKKFDSSRDRNKPFKFMLGKQEVIRGWEEGVAQMSVGQRAKLTISPDYAYGATGHPGIIPPHATLVFDVELLKLE

SEQ ID NO: 1798 - protein, 530 aa, Artificial Sequence
  source: /note="Description of Artificial Sequence: Synthetic Chimeric Antigen Receptor sequence"
MALPVTALLLPLALLLHAARPDIMMTQSPSSLAVSAGEKVTMTCKSSQSVLYSSNQKNYLAWYQQKPGQSPKLLIYWASTRESGVPDRFTGSGSGTDFTLTISSVQPEDLAVYYCHQYLSSHTFGGGTKLEIKRGGGGSGGGGSGGGGSQLQQPGAELVRPGSSVKLSCKASGYTFTRYWIHWVKQRPIQGLEWIGNIDPSDSETHYNQKFKDKATLTVDKSSGTAYMQLSSLTSEDSAVYYCATEDLYYAMEYWGQGTSVTVSSTTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSKRGRKKLLYIFKQPFMRPVQTTQEEDGCSCRFPEEEEGGCELRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPR

SEQ ID NO: 1799 - protein, 550 aa, Artificial Sequence
  source: /note="Description of Artificial Sequence: Synthetic Chimeric Antigen Receptor sequence"
MALPVTALLLPLALLLHAARPEIVLTQSPGTLSLSPGERATLSCRASQSVSSSYLAWYQQKPGQAPRLLIYGASSRATGIPDRFSGSGSGTDFTLTISRLEPEDFAVYYCQQYGSSRFTFGPGTKVDIKGSTSGSGKPGSGEGSTKGQVQLVQSGAEVKKPGSSVKVSCKDSGGTFSSYAISWVRQAPGQGLEWMGGIIPIFGTTNYAQQFQGRVTITADESTSTAYMELSSLRSEDTAVYYCAREAVAADWLDPWGQGTLVTVSSFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSQRRKYRSNKGESPVEPAEPCRYSCPREEEGSTIPIQEDYRKPEPACSPRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1800 - protein, 554 aa, Artificial Sequence
  source: /note="Description of Artificial Sequence: Synthetic Chimeric Antigen Receptor sequence"
MLLLVTSLLLCELPHPAFLLIPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGSTSGSGKPGSGEGSTKGEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSAAAFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSQRRKYRSNKGESPVEPAEPCRYSCPREEEGSTIPIQEDYRKPEPACSPRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1801 - protein, 556 aa, Artificial Sequence
  source: /note="Description of Artificial Sequence: Synthetic Chimeric Antigen Receptor sequence"
MALPVTALLLPLALLLHAARPEIVLTQSPGTLSLSPGERATLSCRASQSVSSSYLAWYQQKPGQAPRLLIYGASSRATGIPDRFSGSGSGTDFTLTISRLEPEDFAVYYCQQYGSSRFTFGPGTKVDIKGSTSGSGKPGSGEGSTKGQVQLVQSGAEVKKPGSSVKVSCKDSGGTFSSYAISWVRQAPGQGLEWMGGIIPIFGTTNYAQQFQGRVTITADESTSTAYMELSSLRSEDTAVYYCAREAVAADWLDPWGQGTLVTVSSFVPVFLPAKPTTTPAPRPPTPAPTIASQPLSLRPEACRPAAGGAVHTRGLDFACDIYIWAPLAGTCGVLLLSLVITLYCNHRNQRRKYRSNKGESPVEPAEPCRYSCPREEEGSTIPIQEDYRKPEPACSPRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1802 - protein, 560 aa, Artificial Sequence
  source: /note="Description of Artificial Sequence: Synthetic Chimeric Antigen Receptor sequence"
MLLLVTSLLLCELPHPAFLLIPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGSTSGSGKPGSGEGSTKGEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSAAAFVPVFLPAKPTTTPAPRPPTPAPTIASQPLSLRPEACRPAAGGAVHTRGLDFACDIYIWAPLAGTCGVLLLSLVITLYCNHRNQRRKYRSNKGESPVEPAEPCRYSCPREEEGSTIPIQEDYRKPEPACSPRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1803 - protein, 580 aa, Artificial Sequence
  source: /note="Description of Artificial Sequence: Synthetic Chimeric Antigen Receptor sequence"
MLLLVTSLLLCELPHPAFLLIPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGSTSGSGKPGSGEGSTKGEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSESKYGPPCPPCPGGGSSGGGSGGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKMFWVLVVVGGVLACYSLLVTVAFIIFWVRSKRSRGGHSDYMNMTPRRPGPTRKHYQPYAPPRDFAAYRSGGGRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1804 - protein, 680 aa, Artificial Sequence
  source: /note="Description of Artificial Sequence: Synthetic Chimeric Antigen Receptor sequence"
MLLLVTSLLLCELPHPAFLLIPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGSTSGSGKPGSGEGSTKGEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSESKYGPPCPPCPAPEFEGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKMFWVLVVVGGVLACYSLLVTVAFIIFWVRSKRSRGGHSDYMNMTPRRPGPTRKHYQPYAPPRDFAAYRSGGGRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1805 - protein, 680 aa, Artificial Sequence
  source: /note="Description of Artificial Sequence: Synthetic Chimeric Antigen Receptor sequence"
MLLLVTSLLLCELPHPAFLLIPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGSTSGSGKPGSGEGSTKGEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSESKYGPPCPPCPAPEFLGGPSVFLFPPKPKDTLMISRTPEVTCVVVDVSQEDPEVQFNWYVDGVEVHNAKTKPREEQFQSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKMFWVLVVVGGVLACYSLLVTVAFIIFWVRSKRSRGGHSDYMNMTPRRPGPTRKHYQPYAPPRDFAAYRSGGGRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1806 - protein, 680 aa, Artificial Sequence
  source: /note="Description of Artificial Sequence: Synthetic Chimeric Antigen Receptor sequence"
MLLLVTSLLLCELPHPAFLLIPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGSTSGSGKPGSGEGSTKGEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSESKYGPPCPPCPAPEFEGGPSVFLFPPKPKDTLMISRTPEVTCVVVDVSQEDPEVQFNWYVDGVEVHNAKTKPREEQFQSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKMFWVLVVVGGVLACYSLLVTVAFIIFWVRSKRSRGGHSDYMNMTPRRPGPTRKHYQPYAPPRDFAAYRSGGGRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1807 - protein, 681 aa, Artificial Sequence
  source: /note="Description of Artificial Sequence: Synthetic Chimeric Antigen Receptor sequence"
MGTSLLCWMALCLLGADHADAQVQLQQSGPELVKPGASVKISCKASGYAFSSSWMNWVKQRPGKGLEWIGRIYPGDEDTNYSGKFKDKATLTADKSSTTAYMQLSSLTSEDSAVYFCARSLLYGDYLDYWGQGTTLTVSSGGGGSGGGGSGGGGSQIVLTQSPAIMSASPGEKVTMTCSASSSVSYMHWYQQKSGTSPKRWIYDTSKLASGVPDRFSGSGSGTSYFLTINNMEAEDAATYYCQQWNINPLTFGAGTKLELKRSDPAEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKKDPKFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1808 - protein, 711 aa, Artificial Sequence
  source: /note="Description of Artificial Sequence: Synthetic Chimeric Antigen Receptor sequence"
MLLLVTSLLLLCELPHPAFLLIPDIQMTQQTTSSLSASLGDRVTISCRASSQDISKYLNWYQQKPDGTVKLLLIYHTSRLHSGVPSRFSGSGGSGTDYSLTISNLEQEDIATYYFCQQGNTLPYTFGGGTKLEIITGSTSGSGKPGSGEGSTKGEEVKLQESGPGLVAPSQSLSVTTCTVSGVSLPDYGVSWIRQPPPRKGLEWLGVIWGSETTYYNSSALKSRLTIIKDNSKSQVFLKKMNSLQTDDTAIYYCAKHYYYYGGSYAMDYWGQGTSVTVSSEESKYGPPCPPCPAPEFLGGPSSVFLFPPKPKDTLMISRTPEVVTCVVVDVSQEDPEVQFNWYVVDGVEVHNAKTKPREEQFNSTTYRVVSVLTVLHQDWLNGKEYYKCKVSNKGLPSSIEKTISKAAKGQPREPQVYTLPPSQEEMTTKNQVSLTCLVKGFYPSDIAVVEWESNGQPENNYKTTPPVLDDSDGSFFLYSRLTVDKSRWQEEGNVFSCSVMHEALHNHYTQKKSLSLSLGKMFWVLVVVGGVLLACYSLLVTVAFIIFWVRSKRRSRGGHSDYMNMTPRRPGPTRRKHYQPYAPPRDFAAYRSRVKKFSRSADAPAYQQGQNQLYNEELNLGRREEYDVLDKRRGRDPPEMGGKPRRKNPQEGLYNELQQKDKMAEAYSEIGMKGERRRGGKGHDGLYQGLSTATKDTYDAALHMQALPPR

SEQ ID NO: 1809 - protein, 737 aa, Artificial Sequence
  source: /note="Description of Artificial Sequence: Synthetic Chimeric Antigen Receptor sequence"
EIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSSGGGGSGGGGSGGGGSGGGGSEVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCARDLGWIAVAGTFDYWGQGTLVTVSSGGGGSGGGGSGGGGSQSALTQPASVSGSPGQSITISCTGTSSDVGGYNYVSWYQQHPGKAPKLMIYDVSKRPSGVSNRFSGSKSGNTASLTISGLQAEDEADYYCSSYTSSSLNHVFGTGTKVTVLTTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1810 - protein, 819 aa, Artificial Sequence
  source: /note="Description of Artificial Sequence: Synthetic polypeptide"
DIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGSTSGSGKPGSGEGSTKGEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSESKYGPPCPPCPMFWVLVVVGGVLACYSLLVTVAFIIFWVKRGRKKLLYIFKQPFMRPVQTTQEEDGCSCRFEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRLEGGGEGRGSLLTCGDVEENPGPRMLLLVTSLLLCELPHPAFLLIPRKVCNGIGIGEFKDSLSINATNIKHFKNCTSISGDLHILPVAFRGDSFTHTPPLDPQELDILKTVKEITGFLLIQAWPENRTDLHAFENLEIIRGRTKQHGQFSLAVVSLNITSLGLRSLKEISDGDVIISGNKNLCYANTINWKKLFGTSGQKTKIISNRGENSCKATGQVCHALCSPEGCWGPEPRDCVSCRNVSRGRECVDKCNLLEGEPREFVENSECIQCHPECLPQAMNITCTGRGPDNCIQCAHYIDGPHCVKTCPAGVMGENNTLVWKYADAGHVCHLCHPNCTYGCTGPGLEGCPTNGPKIPSIATGMVGALLLLLVVALGIGLFM

SEQ ID NO: 1811 - protein, 838 aa, Artificial Sequence
  source: /note="Description of Artificial Sequence: Synthetic Chimeric Antigen Receptor sequence"
MLLLVTSLLLCELPHPAFLLIPQSVKESEGDLVTPAGNLTLTCTASGSDINDYPISWVRQAPGKGLEWIGFINSGGSTWYASWVKGRFTISRTSTTVDLKMTSLTTDDTATYFCARGYSTYYGDFNIWGPGTLVTISSGGGGSGGGGSGGGGSELVMTQTPSSTSGAVGGTVTINCQASQSIDSNLAWFQQKPGQPPTLLIYRASNLASGVPSRFSGSRSGTEYTLTISGVQREDAATYYCLGGVGNVSYRTSFGGGTEVVVKESKYGPPCPPCPMFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRLEGGGEGRGSLLTCGDVEENPGPRMLLLVTSLLLCELPHPAFLLIPRKVCNGIGIGEFKDSLSINATNIKHFKNCTSISGDLHILPVAFRGDSFTHTPPLDPQELDILKTVKEITGFLLIQAWPENRTDLHAFENLEIIRGRTKQHGQFSLAVVSLNITSLGLRSLKEISDGDVIISGNKNLCYANTINWKKLFGTSGQKTKIISNRGENSCKATGQVCHALCSPEGCWGPEPRDCVSCRNVSRGRECVDKCNLLEGEPREFVENSECIQCHPECLPQAMNITCTGRGPDNCIQCAHYIDGPHCVKTCPAGVMGENNTLVWKYADAGHVCHLCHPNCTYGCTGPGLEGCPTNGPKIPSIATGMVGALLLLLVVALGIGLFM

SEQ ID NO: 1812 - protein, 845 aa, Artificial Sequence
  source: /note="Description of Artificial Sequence: Synthetic Chimeric Antigen Receptor sequence"
MLLLVTSLLLCELPHPAFLLIPQEQLVESGGRLVTPGGSLTLSCKASGFDFSAYYMSWVRQAPGKGLEWIATIYPSSGKTYYATWVNGRFTISSDNAQNTVDLQMNSLTAADRATYFCARDSYADDGALFNIWGPGTLVTISSGGGGSGGGGSGGGGSELVLTQSPSVSAALGSPAKITCTLSSAHKTDTIDWYQQLQGEAPRYLMQVQSDGSYTKRPGVPDRFSGSSSGADRYLIIPSVQADDEADYYCGADYIGGYVFGGGTQLTVTGESKYGPPCPPCPMFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRLEGGGEGRGSLLTCGDVEENPGPRMLLLVTSLLLCELPHPAFLLIPRKVCNGIGIGEFKDSLSINATNIKHFKNCTSISGDLHILPVAFRGDSFTHTPPLDPQELDILKTVKEITGFLLIQAWPENRTDLHAFENLEIIRGRTKQHGQFSLAVVSLNITSLGLRSLKEISDGDVIISGNKNLCYANTINWKKLFGTSGQKTKIISNRGENSCKATGQVCHALCSPEGCWGPEPRDCVSCRNVSRGRECVDKCNLLEGEPREFVENSECIQCHPECLPQAMNITCTGRGPDNCIQCAHYIDGPHCVKTCPAGVMGENNTLVWKYADAGHVCHLCHPNCTYGCTGPGLEGCPTNGPKIPSIATGMVGALLLLLVVALGIGLFM

SEQ ID NO: 1813 - protein, 945 aa, Artificial Sequence
  source: /note="Description of Artificial Sequence: Synthetic Chimeric Antigen Receptor sequence"
MLLLVTSLLLCELPHPAFLLIPQSVKESEGDLVTPAGNLTLTCTASGSDINDYPISWVRQAPGKGLEWIGFINSGGSTWYASWVKGRFTISRTSTTVDLKMTSLTTDDTATYFCARGYSTYYGDFNIWGPGTLVTISSGGGGSGGGGSGGGGSELVMTQTPSSTSGAVGGTVTINCQASQSIDSNLAWFQQKPGQPPTLLIYRASNLASGVPSRFSGSRSGTEYTLTISGVQREDAATYYCLGGVGNVSYRTSFGGGTEVVVKESKYGPPCPPCPGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKMFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRLEGGGEGRGSLLTCGDVEENPGPRMLLLVTSLLLCELPHPAFLLIPRKVCNGIGIGEFKDSLSINATNIKHFKNCTSISGDLHILPVAFRGDSFTHTPPLDPQELDILKTVKEITGFLLIQAWPENRTDLHAFENLEIIRGRTKQHGQFSLAVVSLNITSLGLRSLKEISDGDVIISGNKNLCYANTINWKKLFGTSGQKTKIISNRGENSCKATGQVCHALCSPEGCWGPEPRDCVSCRNVSRGRECVDKCNLLEGEPREFVENSECIQCHPECLPQAMNITCTGRGPDNCIQCAHYIDGPHCVKTCPAGVMGENNTLVWKYADAGHVCHLCHPNCTYGCTGPGLEGCPTNGPKIPSIATGMVGALLLLLVVALGIGLFM

SEQ ID NO: 1814 - protein, 952 aa, Artificial Sequence
  source: /note="Description of Artificial Sequence: Synthetic Chimeric Antigen Receptor sequence"
MLLLVTSLLLCELPHPAFLLIPQEQLVESGGRLVTPGGSLTLSCKASGFDFSAYYMSWVRQAPGKGLEWIATIYPSSGKTYYATWVNGRFTISSDNAQNTVDLQMNSLTAADRATYFCARDSYADDGALFNIWGPGTLVTISSGGGGSGGGGSGGGGSELVLTQSPSVSAALGSPAKITCTLSSAHKTDTIDWYQQLQGEAPRYLMQVQSDGSYTKRPGVPDRFSGSSSGADRYLIIPSVQADDEADYYCGADYIGGYVFGGGTQLTVTGESKYGPPCPPCPGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKMFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRLEGGGEGRGSLLTCGDVEENPGPRMLLLVTSLLLCELPHPAFLLIPRKVCNGIGIGEFKDSLSINATNIKHFKNCTSISGDLHILPVAFRGDSFTHTPPLDPQELDILKTVKEITGFLLIQAWPENRTDLHAFENLEIIRGRTKQHGQFSLAVVSLNITSLGLRSLKEISDGDVIISGNKNLCYANTINWKKLFGTSGQKTKIISNRGENSCKATGQVCHALCSPEGCWGPEPRDCVSCRNVSRGRECVDKCNLLEGEPREFVENSECIQCHPECLPQAMNITCTGRGPDNCIQCAHYIDGPHCVKTCPAGVMGENNTLVWKYADAGHVCHLCHPNCTYGCTGPGLEGCPTNGPKIPSIATGMVGALLLLLVVALGIGLFM

SEQ ID NO: 1815 - protein, 1055 aa, Artificial Sequence [sequence omitted]

SEQ ID NO: 1816 - protein, 1062 aa, Artificial Sequence
  source: /note="Description of Artificial Sequence: Synthetic Chimeric Antigen Receptor sequence"
MLLLVTSLLLCELPHPAFLLIPQEQLVESGGRLVTPGGSLTLSCKASGFDFSAYYMSWVRQAPGKGLEWIATIYPSSGKTYYATWVNGRFTISSDNAQNTVDLQMNSLTAADRATYFCARDSYADDGALFNIWGPGTLVTISSGGGGSGGGGSGGGGSELVLTQSPSVSAALGSPAKITCTLSSAHKTDTIDWYQQLQGEAPRYLMQVQSDGSYTKRPGVPDRFSGSSSGADRYLIIPSVQADDEADYYCGADYIGGYVFGGGTQLTVTGESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKMFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRLEGGGEGRGSLLTCGDVEENPGPRMLLLVTSLLLCELPHPAFLLIPRKVCNGIGIGEFKDSLSINATNIKHFKNCTSISGDLHILPVAFRGDSFTHTPPLDPQELDILKTVKEITGFLLIQAWPENRTDLHAFENLEIIRGRTKQHGQFSLAVVSLNITSLGLRSLKEISDGDVIISGNKNLCYANTINWKKLFGTSGQKTKIISNRGENSCKATGQVCHALCSPEGCWGPEPRDCVSCRNVSRGRECVDKCNLLEGEPREFVENSECIQCHPECLPQAMNITCTGRGPDNCIQCAHYIDGPHCVKTCPAGVMGENNTLVWKYADAGHVCHLCHPNCTYGCTGPGLEGCPTNGPKIPSIATGMVGALLLLLVVALGIGLFM

SEQ ID NO: 1817 - protein, 1124 aa, Artificial Sequence
  source: /note="Description of Artificial Sequence: Synthetic Chimeric Antigen Receptor sequence"
MSLPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITKAGGGGSGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSDPTTTPAPRPPTPAPTIASQPLSLRPEACRPAAGGAVHTRGLDFACDIFVWLVWGGVLACYSLLVTVAFIIFWVRRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRRAEGRGSLLTCGDVEENPGPMAVPTQVLGLLLLWLTDARCDIQMTQSPSSLSASVGDRVTITCRASEDIYFNLVWYQQKPGKAPKLLIYDTNRLADGVPSRFSGSGSGTQYTLTISSLQPEDFATYYCQHYKNYPLTFGQGTKLEIKRSGGGGSGGGGSGGGGSGGGGSRSEVQLVESGGGLVQPGGSLRLSCAASGFTLSNYGMHWIRQAPGKGLEWVSSISLNGGSTYYRDSVKGRFTISRDNAKSTLYLQMNSLRAEDTAVYYCAAQDAYTGGYFDYWGQGTLVTVSSMDPAEPKSPDKTHTCPPCPAPPVAGPSVFLFPPKPKDTLMIARTPEVTCVWDVSHEDPEVKFNWYVDGVEVHNAKTKPREEQYNSTYRWSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKKDPKFWVLVWGGVLACYSLLVTVAFIIFWVRSRVFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1818 - protein, 486 aa, Artificial Sequence
  source: /note="Description of Artificial Sequence: Synthetic Chimeric Antigen Receptor sequence"
MALPVTALLLPLALLLHAARPQVQLQESGPGLVKPSETLSLTCTVSGVSLPDYGVSWIRQPPGKGLEWIGVIWGSETTYYSSSLKSRVTISKDNSKNQVSLKLSSVTAADTAVYYCAKHYYYGGSYAMDYWGQGTLVTVSSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1819 - protein, 491 aa, Artificial Sequence
  source: /note="Description of Artificial Sequence: Synthetic Chimeric Antigen Receptor sequence"
MALPVTALLLPLALLLHAARPEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSGGGGSQVQLQESGPGLVKPSETLSLTCTVSGVSLPDYGVSWIRQPPGKGLEWIGVIWGSETTYYSSSLKSRVTISKDNSKNQVSLKLSSVTAADTAVYYCAKHYYYGGSYAMDYWGQGTLVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1820 - protein, 491 aa, Artificial Sequence
  source: /note="Description of Artificial Sequence: Synthetic Chimeric Antigen Receptor sequence"
MALPVTALLLPLALLLHAARPEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSGGGGSQVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1821 - protein, 491 aa, Artificial Sequence
  source: /note="Description of Artificial Sequence: Synthetic Chimeric Antigen Receptor sequence"
MALPVTALLLPLALLLHAARPQVQLQESGPGLVKPSETLSLTCTVSGVSLPDYGVSWIRQPPGKGLEWIGVIWGSETTYYSSSLKSRVTISKDNSKNQVSLKLSSVTAADTAVYYCAKHYYYGGSYAMDYWGQGTLVTVSSGGGGSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1822 - protein, 491 aa, Artificial Sequence
  source: /note="Description of Artificial Sequence: Synthetic Chimeric Antigen Receptor sequence"
MALPVTALLLPLALLLHAARPQVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSSGGGGSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1823 - protein, 491 aa, Artificial Sequence
  source: /note="Description of Artificial Sequence: Synthetic Chimeric Antigen Receptor sequence"
MALPVTALLLPLALLLHAARPQVQLQESGPGLVKPSETLSLTCTVSGVSLPDYGVSWIRQPPGKGLEWIGVIWGSETTYYNSSLKSRVTISKDNSKNQVSLKLSSVTAADTAVYYCAKHYYYGGSYAMDYWGQGTLVTVSSGGGGSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1824 - protein, 486 aa, Artificial Sequence
  source: /note="Description of Artificial Sequence: Synthetic Chimeric Antigen Receptor sequence"
MALPVTALLLPLALLLHAARPEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYNSSLKSRVTISKDNSKNQVSLKLSSVTAADTAVYYCAKHYYYGGSYAMDYWGQGTLVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1825 - protein, 939 aa, Artificial Sequence
  source: /note="Description of Artificial Sequence: Synthetic polypeptide"
MALPVTALLLPLALLLHAARPGSRGVQVETISPGDGRTFPKRGQTCVVHYTGMLEDGKKMDSSRDRNKPFKFMLGKQEVIRGWEEGVAQMSVGQRAKLTISPDYAYGATGHPGIIPPHATLVFDVELLKLETRGVQVETISPGDGRTFPKRGQTCVVHYTGMLEDGKKMDSSRDRNKPFKFMLGKQEVIRGWEEGVAQMSVGQRAKLTISPDYAYGATGHPGIIPPHATLVFDVELLKLETRGVQVETISPGDGRTFPKRGQTCVVHYTGMLEDGKKMDSSRDRNKPFKFMLGKQEVIRGWEEGVAQMSVGQRAKLTISPDYAYGATGHPGIIPPHATLVFDVELLKLETRGVQVETISPGDGRTFPKRGQTCVVHYTGMLEDGKKMDSSRDRNKPFKFMLGKQEVIRGWEEGVAQMSVGQRAKLTISPDYAYGATGHPGIIPPHATLVFDVELLKLETSARNRRKRGSDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSASTTTPAPRPPTPAPTIASQPLSLRPEACRPAAGGAVHTRGLDFACDSGIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRZ

SEQ ID NO: 1826 - protein, 970 aa, Artificial Sequence
  source: /note="Description of Artificial Sequence: Synthetic Chimeric Antigen Receptor sequence"
MLLLVTSLLLCELPHPAFLLIPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGSTSGSGKPGSGEGSTKGEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSGGGGSEVQLQQSGAELVKPGASVKMSCKASGYTFTSYNMHWVKQTPGQGLEWIGAIYPGNGDTSYNQKFKGKATLTADKSSSTAYMQLSSLTSEDSADYYCARSNYYGSSYWFFDVWGAGTTVTVSSGSTSGGGSGGGSGGGGSSDIVLTQSPAILSASPGEKVTMTCRASSSVNYMDWYQKKPGSSPKPWIYATSNLASGVPARFSGSGSGTSYSLTISRVEAEDAATYYCQQWSFNPPTFGGGTKLEIKESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKMFWVLVVVGGVLACYSLLVTVAFIIFWVRSKRSRGGHSDYMNMTPRRPGPTRKHYQPYAPPRDFAAYRSKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1827 - protein, 1090 aa, Artificial Sequence
  source: /note="Description of Artificial Sequence: Synthetic Chimeric Antigen Receptor sequence"
MLLLVTSLLLCELPHPAFLLIPMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGSTSGSGKPGSGEGSTKGEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSGGGGSEVQLQQSGAELVKPGASVKMSCKASGYTFTSYNMHWVKQTPGQGLEWIGAIYPGNGDTSYNQKFKGKATLTADKSSSTAYMQLSSLTSEDSADYYCARSNYYGSSYWFFDVWGAGTTVTVSSGSTSGGGSGGGSGGGGSSDIVLTQSPAILSASPGEKVTMTCRASSSVNYMDWYQKKPGSSPKPWIYATSNLASGVPARFSGSGSGTSYSLTISRVEAEDAATYYCQQWSFNPPTFGGGTKLEIKESKYGPPCPPCPMFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRLEGGGEGRGSLLTCGDVEENPGPRMLLLVTSLLLCELPHPAFLLIPRKVCNGIGIGEFKDSLSINATNIKHFKNCTSISGDLHILPVAFRGDSFTHTPPLDPQELDILKTVKEITGFLLIQAWPENRTDLHAFENLEIIRGRTKQHGQFSLAVVSLNITSLGLRSLKEISDGDVIISGNKNLCYANTINWKKLFGTSGQKTKIISNRGENSCKATGQVCHALCSPEGCWGPEPRDCVSCRNVSRGRECVDKCNLLEGEPREFVENSECIQCHPECLPQAMNITCTGRGPDNCIQCAHYIDGPHCVKTCPAGVMGENNTLVWKYADAGHVCHLCHPNCTYGCTGPGLEGCPTNGPKIPSIATGMVGALLLLLVVALGIGLFM

SEQ ID NO: 1828 - protein, 1133 aa, Artificial Sequence
  source: /note="Description of Artificial Sequence: Synthetic Chimeric Antigen Receptor sequence"
MLLLVTSLLLCELPHPAFLLIPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGSTSGSGKPGSGEGSTKGEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSGGGGSEVQLQQSGAELVKPGASVKMSCKASGYTFTSYNMHWVKQTPGQGLEWIGAIYPGNGDTSYNQKFKGKATLTADKSSSTAYMQLSSLTSEDSADYYCARSNYYGSSYWFFDVWGAGTTVTVSSGSTSGGGSGGGSGGGGSSDIVLTQSPAILSASPGEKVTMTCRASSSVNYMDWYQKKPGSSPKPWIYATSNLASGVPARFSGSGSGTSYSLTISRVEAEDAATYYCQQWSFNPPTFGGGTKLEIKESKYGPPCPPCPKPTTTPAPRPPTPAPTIASQPLSLRPEACRPAAGGAVHTRGLDFACDIYIWAPLAGTCGVLLLSLVITKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRLEGGGEGRGSLLTCGDVEENPGPRMLLLVTSLLLCELPHPAFLLIPRKVCNGIGIGEFKDSLSINATNIKHFKNCTSISGDLHILPVAFRGDSFTHTPPLDPQELDILKTVKEITGFLLIQAWPENRTDLHAFENLEIIRGRTKQHGQFSLAVVSLNITSLGLRSLKEISDGDVIISGNKNLCYANTINWKKLFGTSGQKTKIISNRGENSCKATGQVCHALCSPEGCWGPEPRDCVSCRNVSRGRECVDKCNLLEGEPREFVENSECIQCHPECLPQAMNITCTGRGPDNCIQCAHYIDGPHCVKTCPAGVMGENNTLVWKYADAGHVCHLCHPNCTYGCTGPGLEGCPTNGPKIPSIATGMVGALLLLLVVALGIGLFM

SEQ ID NO: 1829 - protein, 727 aa, Artificial Sequence
  source: /note="Description of Artificial Sequence: Synthetic Chimeric Antigen Receptor sequence"
MVLLVTSLLLCELPHPAFLLIPDTEVQLVESGGGLVKPGGSLKLSCAASGFAFSIYDMSWVRQTPEKRLEWVAYISSGGGTYYPDTVKGRFTISRDNAKNTLYLQMSSLKSEDTAMYYCARHSGYGTHWGVLFAYWGQGTLVTVSAGGGGSGGGGSGGGGSDIQMTQTTSSLSASLGDRVTISCRASQDISNYLNWYQQKPDGTVKLLIYYTSILHSGVPSRFSGSGSGTDYSLTISNLEQEDFATYFCQQGNTLPWTFGGGTKLEIKAEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKKDPKAAAIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1830 - protein, 266 aa, Artificial Sequence
  source: /note="Description of Artificial Sequence: Synthetic Chimeric Antigen Receptor sequence"
METDTLLLWVLLLWVPGSTGDIVLTQSPAILSASPGEKVTMTCRASSSVNYMDWYQKKPGSSPKPWIYATSNLASGVPARFSGSGSGTSYSLTISRVEAEDAATYYCQQWSFNPPTFGGGTKLEIKGSTSGGGSGGGSGGGGSSEVQLQQSGAELVKPGASVKMSCKASGYTFTSYNMHWVKQTPGQGLEWIGAIYPGNGDTSYNQKFKGKATLTADKSSSTAYMQLSSLTSEDSADYYCARSNYYGSSYWFFDVWGAGTTVTVSS

SEQ ID NO: 1831 - protein, 529 aa, Artificial Sequence
  source: /note="Description of Artificial Sequence: Synthetic Chimeric Antigen Receptor sequence"
MALPVTALLLPLALLLHAARPDIVMTQSPATLSVTPGDRVSLSCRASQSISDYLHWYQQKSHESPRLLIKYASQSISGIPSRFSGSGSGSDFTLSINSVEPEDVGVYYCQNGHSFPLTFGAGTKLELRRGGGGSGGGGSGGGGSQVQLQQPGTELVRPGSSVKLSCKASGYTFTSYWVNWVKQRPDQGLEWIGRIDPYDSETHYNQKFTDKAISTIDTSSNTAYMQLSTLTSDASAVYYCSRSPRDSSTNLADWGQGTLVTVSSTTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSKRGRKKLLYIFKQPFMRPVQTTQEEDGCSCRFPEEEEGGCELRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPR

SEQ ID NO: 1832 - protein, 389 aa, Artificial Sequence
  source: /note="Description of Artificial Sequence: Synthetic Chimeric Antigen Receptor sequence"
MALPVTALLLPLALLLHAARPGSGSGAQAAEVQLVESGGGLVQPGRSLRLSCAASGFTFNDYAMHWVRQAPGKGLEWVSTISWNSGSIGYADSVKGRFTISRDNAKKSLYLQMNSLRAEDTALYYCAKDIQYGNYYYGMDVWGQGTTVTVSSGGGGSGGGGSGGGGSEIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTRLEIKRSDPASGAGSGSGSAIELLPVPGAKKSAKLYIPYIILTIIILTIVGFIWLLKVNGCRKYKLNKTESTPVVEEDEMQPYASYTEKNNPLYDTTNKVKASEALQSEVDTDLHTLSHG

SEQ ID NO: 1833 - protein, 381 aa, Artificial Sequence
  source: /note="Description of Artificial Sequence: Synthetic Chimeric Antigen Receptor sequence"
MALPVTALLLPLALLLHAARPGSGSGAQAAEVQLVESGGGLVQPGRSLRLSCAASGFTFNDYAMHWVRQAPGKGLEWVSTISWNSGSIGYADSVKGRFTISRDNAKKSLYLQMNSLRAEDTALYYCAKDIQYGNYYYGMDVWGQGTTVTVSSGGGGSGGGGSGGGGSEIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTRLEIKRSDPASGAGSGSGSAVKEGPPSEHSGISRNAIIFLVLGILVFLILLGIGIYFYWSKCSREVLWHCHLCPSSTEHASASANGHVSYSAVSRENSSSQDPQTEGTRSHG

SEQ ID NO: 1834 - protein, 389 aa, Artificial Sequence
  source: /note="Description of Artificial Sequence: Synthetic Chimeric Antigen Receptor sequence"
MALPVTALLLPLALLLHAARPGSGSGAQAAEVQLVESGGGLVQPGRSLRLSCAASGFTFNDYAMHWVRQAPGKGLEWVSTISWNSGSIGYADSVKGRFTISRDNAKKSLYLQMNSLRAEDTALYYCAKDIQYGNYYYGMDVWGQGTTVTVSSGGGGSGGGGSGGGGSEIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTRLEIKRSDPASGAGSGSGSAVQAPSSSPMGIIVAVVTGIAVAAIVAAVVALIYCRKKRISALPGYPECREMGETLPEKPANPTNPDEADKVGAENTITYSLLMHPDALEEPDDQNRISHG

SEQ ID NO: 1835 - protein, 407 aa, Artificial Sequence
  source: /note="Description of Artificial Sequence: Synthetic Chimeric Antigen Receptor sequence"
MALPVTALLLPLALLLHAARPGSGSGAQAAEVQLVESGGGLVQPGRSLRLSCAASGFTFNDYAMHWVRQAPGKGLEWVSTISWNSGSIGYADSVKGRFTISRDNAKKSLYLQMNSLRAEDTALYYCAKDIQYGNYYYGMDVWGQGTTVTVSSGGGGSGGGGSGGGGSEIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTRLEIKRSDPASGAGSGSGSASFRALPHAWSDPSDPLPVSVTGNSRYLHALIGTSVVIIPFAILLFFLLHRWCANKKNAVVMDQEPAGNRTVNREDSDEQDPQEVTYAQLNHCVFTQRKITRPSQRPKTPPTDTSVSHG

SEQ ID NO: 1836 - protein, 412 aa, Artificial Sequence
  source: /note="Description of Artificial Sequence: Synthetic Chimeric Antigen Receptor sequence"
MALPVTALLLPLALLLHAARPGSGSGAQAAEVQLVESGGGLVQPGRSLRLSCAASGFTFNDYAMHWVRQAPGKGLEWVSTISWNSGSIGYADSVKGRFTISRDNAKKSLYLQMNSLRAEDTALYYCAKDIQYGNYYYGMDVWGQGTTVTVSSGGGGSGGGGSGGGGSEIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTRLEIKRSDPASGAGSGSGSALFVHWKPEGRAGGVLGAVWGASITTLVFLCVCFIFRVKTRRKKAAQPVQNTDDVNPVMVSGSRGHQHQFQTGIVSDHPAEAGPISEDEQELHYAVLHFHKVQPQEPKVTDTEYSEIKIHKSHG

SEQ ID NO: 1837 - protein, 413 aa, Artificial Sequence
  source: /note="Description of Artificial Sequence: Synthetic Chimeric Antigen Receptor sequence"
MALPVTALLLPLALLLHAARPGSGSGAQAAEVQLVESGGGLVQPGRSLRLSCAASGFTFNDYAMHWVRQAPGKGLEWVSTISWNSGSIGYADSVKGRFTISRDNAKKSLYLQMNSLRAEDTALYYCAKDIQYGNYYYGMDVWGQGTTVTVSSGGGGSGGGGSGGGGSEIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTRLEIKRSDPASGAGSGSGSAGPDGYRRDLMTAGVLWGLFGVLGFTGVALLLYALFHKISGESSATNEPRGASRPNPQEFTYSSPTPDMEELQPVYVNVGSVDVDVVYSQVWSMQQPESSANIRTLLENKDSQVIYSSVKKSSHG

SEQ ID NO: 1838 - protein, 415 aa, Artificial Sequence
  source: /note="Description of Artificial Sequence: Synthetic Chimeric Antigen Receptor sequence"
MALPVTALLLPLALLLHAARPGSGSGAQAAEVQLVESGGGLVQPGRSLRLSCAASGFTFNDYAMHWVRQAPGKGLEWVSTISWNSGSIGYADSVKGRFTISRDNAKKSLYLQMNSLRAEDTALYYCAKDIQYGNYYYGMDVWGQGTTVTVSSGGGGSGGGGSGGGGSEIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTRLEIKRSDPASGAGSGSGSAPGHIRLYVVEKENLPVFPVWVVVGIVTAVVLGLTLLISMILAVLYRRKNSKRDYTGCSTSESLSPVKQAPRKSPSDTEGLVKSLPSGSHQGPVIYAQLDHSGGHHSDKINKSESVVYADIRKNSHG

SEQ ID NO: 1839 - protein, 419 aa, Artificial Sequence
  source: /note="Description of Artificial Sequence: Synthetic Chimeric Antigen Receptor sequence"
MALPVTALLLPLALLLHAARPGSGSGAQAAEVQLVESGGGLVQPGRSLRLSCAASGFTFNDYAMHWVRQAPGKGLEWVSTISWNSGSIGYADSVKGRFTISRDNAKKSLYLQMNSLRAEDTALYYCAKDIQYGNYYYGMDVWGQGTTVTVSSGGGGSGGGGSGGGGSEIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTRLEIKRSDPASGAGSGSGSALQSKATSGVTQGVVGGAGATALVFLSFCVIFVVVRSCRKKSARPAAGVGDTGIEDANAVRGSASQGPLTEPWAEDSPPDQPPPASARSSVGEGELQYASLSFQMVKPWDSRGQEATDTEYSEIKIHRSHG

SEQ ID NO: 1840 - protein, 422 aa, Artificial Sequence
  source: /note="Description of Artificial Sequence: Synthetic Chimeric Antigen Receptor sequence"
MALPVTALLLPLALLLHAARPGSGSGAQAAEVQLVESGGGLVQPGRSLRLSCAASGFTFNDYAMHWVRQAPGKGLEWVSTISWNSGSIGYADSVKGRFTISRDNAKKSLYLQMNSLRAEDTALYYCAKDIQYGNYYYGMDVWGQGTTVTVSSGGGGSGGGGSGGGGSEIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTRLEIKRSDPASGAGSGSGSAMPSTGGDSCPFCLKLLLPGLLLLLVVIILILAFWVLPKYKTRKAMRNNVPRDRGDTAMEVGIYANILEKQAKEESVPEVGSRPCVSTAQDEAKHSQELQYATPVFQEVAPREQEACDSYKSGYVYSELNFSHG

SEQ ID NO: 1841 - protein, 423 aa, Artificial Sequence
  source: /note="Description of Artificial Sequence: Synthetic Chimeric Antigen Receptor sequence"
MALPVTALLLPLALLLHAARPGSGSGAQAAEVQLVESGGGLVQPGRSLRLSCAASGFTFNDYAMHWVRQAPGKGLEWVSTISWNSGSIGYADSVKGRFTISRDNAKKSLYLQMNSLRAEDTALYYCAKDIQYGNYYYGMDVWGQGTTVTVSSGGGGSGGGGSGGGGSEIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTRLEIKRSDPASGAGSGSGSALQQEYTGKMRPVSGVLLGAVGGAGATALVFLSFCVIFIVVRSCRKKSARPAADVGDIGMKDANTIRGSASQGNLTESWADDNPRHHGLAAHSSGEEREIQYAPLSFHKGEPQDLSGQEATNNEYSEIKIPKSHG

SEQ ID NO: 1842 - protein, 425 aa, Artificial Sequence
  source: /note="Description of Artificial Sequence: Synthetic Chimeric Antigen Receptor sequence"
MALPVTALLLPLALLLHAARPGSGSGAQAAEVQLVESGGGLVQPGRSLRLSCAASGFTFNDYAMHWVRQAPGKGLEWVSTISWNSGSIGYADSVKGRFTISRDNAKKSLYLQMNSLRAEDTALYYCAKDIQYGNYYYGMDVWGQGTTVTVSSGGGGSGGGGSGGGGSEIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTRLEIKRSDPASGAGSGSGSALQNEYTGKMRPISGVTLGAFGGAGATALVFLYFCIIFVVVRSCRKKSARPAVGVGDTGMEDANAVRGSASQGPLIESPADDSPPHHAPPALATPSPEEGEIQYASLSFHKARPQYPQEQEAIGYEYSEINIPKSHG

SEQ ID NO: 1843 - protein, 428 aa, Artificial Sequence
  source: /note="Description of Artificial Sequence: Synthetic Chimeric Antigen Receptor sequence"
MALPVTALLLPLALLLHAARPGSGSGAQAAEVQLVESGGGLVQPGRSLRLSCAASGFTFNDYAMHWVRQAPGKGLEWVSTISWNSGSIGYADSVKGRFTISRDNAKKSLYLQMNSLRAEDTALYYCAKDIQYGNYYYGMDVWGQGTTVTVSSGGGGSGGGGSGGGGSEIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTRLEIKRSDPASGAGSGSGSALNVTYVPQNPTTGIFPGDGSGKQETRAGVVHGAIGGAGVTALLALCLCLIFFIVKTHRRKAARTAVGRNDTHPTTGSASPKHQKKSKLHGPTETSSCSGAAPTVEMDEELHYASLNFHGMNPSKDTSTEYSEVRTQSHG

SEQ ID NO: 1844 - protein, 428 aa, Artificial Sequence
  source: /note="Description of Artificial Sequence: Synthetic Chimeric Antigen Receptor sequence"
MALPVTALLLPLALLLHAARPGSGSGAQAAEVQLVESGGGLVQPGRSLRLSCAASGFTFNDYAMHWVRQAPGKGLEWVSTISWNSGSIGYADSVKGRFTISRDNAKKSLYLQMNSLRAEDTALYYCAKDIQYGNYYYGMDVWGQGTTVTVSSGGGGSGGGGSGGGGSEIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTRLEIKRSDPASGAGSGSGSAPYEWSNSSDPLLVSVTGNPSNSWPSPTEPSSETGNPRHLHVLIGTSVVIILFILLLFFLLHRWCCNKKNAVVMDQEPAGNRTVNREDSDEQDPQEVTYAQLNHCVFTQRKITRPSQRPKTPPTDIIVYTELPNAEPSHG

SEQ ID NO: 1845 - protein, 430 aa, Artificial Sequence
  source: /note="Description of Artificial Sequence: Synthetic Chimeric Antigen Receptor sequence"
MALPVTALLLPLALLLHAARPGSGSGAQAAEVQLVESGGGLVQPGRSLRLSCAASGFTFNDYAMHWVRQAPGKGLEWVSTISWNSGSIGYADSVKGRFTISRDNAKKSLYLQMNSLRAEDTALYYCAKDIQYGNYYYGMDVWGQGTTVTVSSGGGGSGGGGSGGGGSEIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTRLEIKRSDPASGAGSGSGSALNFTVPTGARSNHLTSGVIEGLLSTLGPATVALLFCYGLKRKIGRRSARDPLRSLPSPLPQEFTYLNSPTPGQLQPIYENVNVVSGDEVYSLAYYNQPEQESVAAETLGTHMEDKVSLDIYSRLRKANITDVDYEDAMSHG

SEQ ID NO: 1846 - protein, 433 aa, Artificial Sequence
  source: /note="Description of Artificial Sequence: Synthetic Chimeric Antigen Receptor sequence"
MALPVTALLLPLALLLHAARPGSGSGAQAAEVQLVESGGGLVQPGRSLRLSCAASGFTFNDYAMHWVRQAPGKGLEWVSTISWNSGSIGYADSVKGRFTISRDNAKKSLYLQMNSLRAEDTALYYCAKDIQYGNYYYGMDVWGQGTTVTVSSGGGGSGGGGSGGGGSEIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTRLEIKRSDPASGAGSGSGSAVTVRETPGNRDGLVAAGATGGLLSALLLAVALLFHCWRRRKSGVGFLGDETRLPPAPGPGESSHSICPAQVELQSLYVDVHPKKGDLVYSEIQTTQLGEEEEANTSRTLLEDKDVSVVYSEVKTQHPDNSAGKISSKDEESSHG

SEQ ID NO: 1847 - protein, 434 aa, Artificial Sequence
  source: /note="Description of Artificial Sequence: Synthetic Chimeric Antigen Receptor sequence"
MALPVTALLLPLALLLHAARPGSGSGAQAAEVQLVESGGGLVQPGRSLRLSCAASGFTFNDYAMHWVRQAPGKGLEWVSTISWNSGSIGYADSVKGRFTISRDNAKKSLYLQMNSLRAEDTALYYCAKDIQYGNYYYGMDVWGQGTTVTVSSGGGGSGGGGSGGGGSEIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTRLEIKRSDPASGAGSGSGSAERRAEVPTAHPSPSPRPAGQFQTLVVGVVGGLLGSLVLLVWVLAVICSRAARGTIGARRTGQPLKEDPSAVPVFSVDYGELDFQWREKTPEPPVPCVPEQTEYATIVFPSGMGTSSPARRGSADGPRSAQPLRPEDGHCSWPLSH

SEQ ID NO: 1848 - protein, 435 aa, Artificial Sequence
  source: /note="Description of Artificial Sequence: Synthetic Chimeric Antigen Receptor sequence"
MALPVTALLLPLALLLHAARPGSGSGAQAAEVQLVESGGGLVQPGRSLRLSCAASGFTFNDYAMHWVRQAPGKGLEWVSTISWNSGSIGYADSVKGRFTISRDNAKKSLYLQMNSLRAEDTALYYCAKDIQYGNYYYGMDVWGQGTTVTVSSGGGGSGGGGSGGGGSEIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTRLEIKRSDPASGAGSGSGSALYITGLTANRSGPFATGVAGGLLSIAGLAAGALLLYCWLSRKAGRKPASDPARSPPDSDSQEPTYHNVPAWEELQPVYTNANPRGENVVYSEVRIIQEKKKHAVASDPRHLRNKGSPIIYSEVKVASTPVSGSLFLASSAPHRSHG

SEQ ID NO: 1849 - protein, 435 aa, Artificial Sequence
  source: /note="Description of Artificial Sequence: Synthetic Chimeric Antigen Receptor sequence"
MALPVTALLLPLALLLHAARPGSGSGAQAAEVQLVESGGGLVQPGRSLRLSCAASGFTFNDYAMHWVRQAPGKGLEWVSTISWNSGSIGYADSVKGRFTISRDNAKKSLYLQMNSLRAEDTALYYCAKDIQYGNYYYGMDVWGQGTTVTVSSGGGGSGGGGSGGGGSEIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTRLEIKRSDPASGAGSGSGSAPYEWSNSSDPLLVSVIGNPSNSWPSPTEPSSKTGNPRHLHILIGTSVVIILFILLFFLLHRWCSNKKNAAVMDQESAGNRTANSEDSDEQDPQEVTYTQLNHCVFTQRKITRPSQRPKTPPTDIIVYAELPNAESRSKVVSCPSHG

SEQ ID NO: 1850 - protein, 436 aa, Artificial Sequence
  source: /note="Description of Artificial Sequence: Synthetic Chimeric Antigen Receptor sequence"
MALPVTALLLPLALLLHAARPGSGSGAQAAEVQLVESGGGLVQPGRSLRLSCAASGFTFNDYAMHWVRQAPGKGLEWVSTISWNSGSIGYADSVKGRFTISRDNAKKSLYLQMNSLRAEDTALYYCAKDIQYGNYYYGMDVWGQGTTVTVSSGGGGSGGGGSGGGGSEIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTRLEIKRSDPASGAGSGSGSAPYEWSDPSDPLLVSVTGNPSSSWPSPTEPSSKSGNPRHLHILIGTSVVIILFILLLFFLLHLWCSNKKNAAVMDQEPAGNRTANSEDSDEQDPEEVTYAQLDHCVFTQRKITRPSQRPKTPPTDTILYTELPNAKPRSKVVSCPSHG

SEQ ID NO: 1851 - protein, 439 aa, Artificial Sequence
  source: /note="Description of Artificial Sequence: Synthetic Chimeric Antigen Receptor sequence"
MALPVTALLLPLALLLHAARPGSGSGAQAAEVQLVESGGGLVQPGRSLRLSCAASGFTFNDYAMHWVRQAPGKGLEWVSTISWNSGSIGYADSVKGRFTISRDNAKKSLYLQMNSLRAEDTALYYCAKDIQYGNYYYGMDVWGQGTTVTVSSGGGGSGGGGSGGGGSEIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTRLEIKRSDPASGAGSGSGSAVRVILAPWKKGLIAVVIIGVIIALLIIAAKCYFLRKAKAKQMPVEMSRPAVPLLNSNNEKMSDPNMEANSHYGHNDDVGNHAMKPINDNKEPLNSDVQYTEVQVSSAESHKDLGKKDTETVYSEVRKAVPDAVESRYSRTEGSLDGTSHG

SEQ ID NO: 1852 - protein, 445 aa, Artificial Sequence
  source: /note="Description of Artificial Sequence: Synthetic Chimeric Antigen Receptor sequence"
MALPVTALLLPLALLLHAARPGSGSGAQAAEVQLVESGGGLVQPGRSLRLSCAASGFTFNDYAMHWVRQAPGKGLEWVSTISWNSGSIGYADSVKGRFTISRDNAKKSLYLQMNSLRAEDTALYYCAKDIQYGNYYYGMDVWGQGTTVTVSSGGGGSGGGGSGGGGSEIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTRLEIKRSDPASGAGSGSGSAQAVTTTTQRPSSMTTTWRLSSTTTTTGLRVTQGKRRSDSWHISLETAVGVAVAVTVLGIMILGLICLLRWRRRKGQQRTKATTPAREPFQNTEEPYENIRNEGQNTDPKLNPKDDGIVYASLALSSSTSPKAPPSHRPLKSPQNETLYSVLKASHG

SEQ ID NO: 1853 - protein, 447 aa, Artificial Sequence
  source: /note="Description of Artificial Sequence: Synthetic Chimeric Antigen Receptor sequence"
MALPVTALLLPLALLLHAARPGSGSGAQAAEVQLVESGGGLVQPGRSLRLSCAASGFTFNDYAMHWVRQAPGKGLEWVSTISWNSGSIGYADSVKGRFTISRDNAKKSLYLQMNSLRAEDTALYYCAKDIQYGNYYYGMDVWGQGTTVTVSSGGGGSGGGGSGGGGSEIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTRLEIKRSDPASGAGSGSGSAPCVWSNSSDPLLVSVTGNPSSSWPSPTEPSSKSGICRHLHVLIGTSVVIFLFILLLFFLLYRWCSNKKNAAVMDQEPAGDRTVNRQDSDEQDPQEVTYAQLDHCVFIQRKISRPSQRPKTPLTDTSVYTELPNAEPRSKVVSCPRAPQSGLEGVFSHG

SEQ ID NO: 1854 - protein, 447 aa, Artificial Sequence
  source: /note="Description of Artificial Sequence: Synthetic Chimeric Antigen Receptor sequence"
MALPVTALLLPLALLLHAARPGSGSGAQAAEVQLVESGGGLVQPGRSLRLSCAASGFTFNDYAMHWVRQAPGKGLEWVSTISWNSGSIGYADSVKGRFTISRDNAKKSLYLQMNSLRAEDTALYYCAKDIQYGNYYYGMDVWGQGTTVTVSSGGGGSGGGGSGGGGSEIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTRLEIKRSDPASGAGSGSGSALQNEGTGTSRPVSQVTLAAVGGAGATALAFLSFCIIFIIVRSCRKKSARPAAGVGDTGMEDAKAIRGSASQGPLTESWKDGNPLKKPPPAVAPSSGEEGELHYATLSFHKVKPQDPQGQEATDSEYSEIKIHKRETAETQACLRNHNPSSKEVRGSHG

SEQ ID NO: 1855 - protein, 463 aa, Artificial Sequence
  source: /note="Description of Artificial Sequence: Synthetic Chimeric Antigen Receptor sequence"
MALPVTALLLPLALLLHAARPGSGSGAQAAEVQLVESGGGLVQPGRSLRLSCAASGFTFNDYAMHWVRQAPGKGLEWVSTISWNSGSIGYADSVKGRFTISRDNAKKSLYLQMNSLRAEDTALYYCAKDIQYGNYYYGMDVWGQGTTVTVSSGGGGSGGGGSGGGGSEIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTRLEIKRSDPASGAGSGSGSAGTSRNRTGLTAAGITGLVLSILVLAAAAALLHYARARRKPGGLSATGTSSHSPSECQEPSSSRPSRIDPQEPTHSKPLAPMELEPMYSNANPGDSNPIYSQIWSIQHTKENSANCPMMHQEHEELTVLYSELKKTHPDDSAGEASSRGRAHEEDDEENYENVPRVLLASDHSHG

SEQ ID NO: 1856 - protein, 464 aa, Artificial Sequence
  source: /note="Description of Artificial Sequence: Synthetic Chimeric Antigen Receptor sequence"
MALPVTALLLPLALLLHAARPGSGSGAQAAEVQLVESGGGLVQPGRSLRLSCAASGFTFNDYAMHWVRQAPGKGLEWVSTISWNSGSIGYADSVKGRFTISRDNAKKSLYLQMNSLRAEDTALYYCAKDIQYGNYYYGMDVWGQGTTVTVSSGGGGSGGGGSGGGGSEIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTRLEIKRSDPASGAGSGSGSAGPSGDPSLSPTGSTPTPGPEDQPLTPTGLDPQSGLGRHLGVVTGVSVAFVLLLFLLLFLLLRHRHQSKHRTSAHFYRPAGAAGPEPKDQGLQKRASPVADIQEEILNAAVKDTQPKDGVEMDARAAASEAPQDVTYAQLHSLTLRREATEPPPSQEREPPAEPSIYAPLAIHSHG

SEQ ID NO: 1857 - protein, 467 aa, Artificial Sequence
  source: /note="Description of Artificial Sequence: Synthetic Chimeric Antigen Receptor sequence"
MALPVTALLLPLALLLHAARPGSGSGAQAAEVQLVESGGGLVQPGRSLRLSCAASGFTFNDYAMHWVRQAPGKGLEWVSTISWNSGSIGYADSVKGRFTISRDNAKKSLYLQMNSLRAEDTALYYCAKDIQYGNYYYGMDVWGQGTTVTVSSGGGGSGGGGSGGGGSEIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTRLEIKRSDPASGAGSGSGSAPYEWSDASDPLPVSVTGNPSSSWPSPTEPSFKTGIARHLHAVIRYSVAIILFTILPFFLLHRWCSKKKDAAVMNQEPAGHRTVNREDSDEQDPQEVTYAQLDHCIFTQRKITGPSQRSKRPSTDTSVCIELPNAEPRALSPAHEHHSQALMGSSRETTALSQTQLASSHVPAAGISHG

SEQ ID NO: 1858 - protein, 467 aa, Artificial Sequence
  source: /note="Description of Artificial Sequence: Synthetic Chimeric Antigen Receptor sequence"
MALPVTALLLPLALLLHAARPGSGSGAQAAEVQLVESGGGLVQPGRSLRLSCAASGFTFNDYAMHWVRQAPGKGLEWVSTISWNSGSIGYADSVKGRFTISRDNAKKSLYLQMNSLRAEDTALYYCAKDIQYGNYYYGMDVWGQGTTVTVSSGGGGSGGGGSGGGGSEIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTRLEIKRSDPASGAGSGSGSAPYEWSDPSDPLLVSVTGNSSSSSSSPTEPSSKTGIRRHLHILIGTSVAIILFIILFFFLLHCCCSNKKNAAVMDQEPAGDRTVNREDSDDQDPQEVTYAQLDHCVFTQTKITSPSQRPKTPPTDTTMYMELPNAKPRSLSPAHKHHSQALRGSSRETTALSQNRVASSHVPAAGISHG

SEQ ID NO: 1859 - protein, 471 aa, Artificial Sequence
  source: /note="Description of Artificial Sequence: Synthetic Chimeric Antigen Receptor sequence"
MALPVTALLLPLALLLHAARPGSGSGAQAAEVQLVESGGGLVQPGRSLRLSCAASGFTFNDYAMHWVRQAPGKGLEWVSTISWNSGSIGYADSVKGRFTISRDNAKKSLYLQMNSLRAEDTALYYCAKDIQYGNYYYGMDVWGQGTTVTVSSGGGGSGGGGSGGGGSEIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTRLEIKRSDPASGAGSGSGSAGPSMGSSPPPTGPISTPAGPEDQPLTPTGSDPQSGLGRHLGVVIGILVAVVLLLLLLLLLFLILRHRRQGKHWTSTQRKADFQHPAGAVGPEPTDRGLQWRSSPAADAQEENLYAAVKDTQPEDGVEMDTRAAASEAPQDVTYAQLHSLTLRRKATEPPPSQEREPPAEPSIYATLAIHSHG

SEQ ID NO: 1860 - protein, 496 aa, Artificial Sequence
  source: /note="Description of Artificial Sequence: Synthetic Chimeric Antigen Receptor sequence"
MALPVTALLLPLALLLHAARPEVQLVESGAEVKKPGASVKVSCKASGYTFTGYYMHWVRQAPGQGLEWMGWINPNSGGTNYAQKFQGRVTMTRDTSISTAYMELSRLRSDDTAVYYCAREPASSSWYGYYYYMDVWGKGTLVTVSSGGGGSGGGGSGGGGSGGGGSDIQMTQSPSSLSASVGDRVTITCRASQSINTYLNWYQQKPGKPPKLLIYAASNLQSGVPSRFSGSGSGTHFTLTISSLQPDDFATYYCQQSYSSLLTFGGGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1861 - protein, 498 aa, Artificial Sequence
  source: /note="Description of Artificial Sequence: Synthetic Chimeric Antigen Receptor sequence"
MALPVTALLLPLALLLHAARPGSGSGAQAAEVQLVESGGGLVQPGRSLRLSCAASGFTFNDYAMHWVRQAPGKGLEWVSTISWNSGSIGYADSVKGRFTISRDNAKKSLYLQMNSLRAEDTALYYCAKDIQYGNYYYGMDVWGQGTTVTVSSGGGGSGGGGSGGGGSEIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTRLEIKRSDPASGAGSGSGSAKNESAASSTGKTPAAEETVTTILGMLASPYHYLIIIVVLVIILAVVVVGFSCRKKFISYLKGICSGGGGGPERVHRVLFRRRSCPSRVPGAEDNARNETLSNRYLQPTQVSEQEIQGQELAELTGVTVELPEEPQRLLEQAEAEGCQRRRLLVPVNDADSADISTLLDASATLEEGHAKETIQDQLVGSEKLFYEEDEAGSATSCLSHG

SEQ ID NO: 1862 - protein, 504 aa, Artificial Sequence
  source: /note="Description of Artificial Sequence: Synthetic Chimeric Antigen Receptor sequence"
MALPVTALLLPLALLLHAARPGSGSGAQAAEVQLVESGGGLVQPGRSLRLSCAASGFTFNDYAMHWVRQAPGKGLEWVSTISWNSGSIGYADSVKGRFTISRDNAKKSLYLQMNSLRAEDTALYYCAKDIQYGNYYYGMDVWGQGTTVTVSSGGGGSGGGGSGGGGSEIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTRLEIKRSDPASGAGSGSGSAGHSGGSSLPPTGPPSTPGLGRYLEVLIGVSVAFVLLLFLLLFLLLRRQRHSKHRTSDQRKTDFQRPAGAAETEPKDRGLLRRSSPAADVQEENLYAAVKDTQSEDRVELDSQSPHDEDPQAVTYAPVKHSSPRREMASPPSSLSGEFLDTKDRQVEEDRQMDTEAAASEASQDVTYAQLHSLTLRRKATEPPPSQEGEPPAEPSIYATLAIHSHG

SEQ ID NO: 1863 - protein, 513 aa, Artificial Sequence
  source: /note="Description of Artificial Sequence: Synthetic Chimeric Antigen Receptor sequence"
MALPVTALLLPLALLLHAARPGSGSGAQAAEVQLVESGGGLVQPGRSLRLSCAASGFTFNDYAMHWVRQAPGKGLEWVSTISWNSGSIGYADSVKGRFTISRDNAKKSLYLQMNSLRAEDTALYYCAKDIQYGNYYYGMDVWGQGTTVTVSSGGGGSGGGGSGGGGSEIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTRLEIKRSDPASGAGSGSGSAVYSLPQLLGPSCSWEAEGLHCRCSFRAWPAPSLCWRLEEKPLEGNSSQGSFKVNSSSPGPWANSSLILHGGLNSDLKVSCKAWNIYGSQSGSVLLLQGRSNLGTGVVPAALGGAGVMALLCICLCLIFFLIVKARRKQAAGRPEKMDDEDPIMGTITSGSRKKPWPDSPGDQASPPGDAPPLEEQKELHYASLSFSEMKSREPKDQEAPSTTEYSEIKTSKSHG

SEQ ID NO: 1864 - protein, 522 aa, Artificial Sequence
  source: /note="Description of Artificial Sequence: Synthetic Chimeric Antigen Receptor sequence"
MALPVTALLLPLALLLHAARPGSGSGAQAAEVQLVESGGGLVQPGRSLRLSCAASGFTFNDYAMHWVRQAPGKGLEWVSTISWNSGSIGYADSVKGRFTISRDNAKKSLYLQMNSLRAEDTALYYCAKDIQYGNYYYGMDVWGQGTTVTVSSGGGGSGGGGSGGGGSEIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTRLEIKRSDPASGAGSGSGSAGSLEGPRPSPTRSVSTAAGPEDQPLMPTGSVPHSGLRRHWEVLIGVLVVSILLLSLLLFLLLQHWRQGKHRTLAQRQADFQRPPGAAEPEPKDGGLQRRSSPAADVQGENFCAAVKNTQPEDGVEMDTRQSPHDEDPQAVTYAKVKHSRPRREMASPPSPLSGEFLDTKDRQAEEDRQMDTEAAASEAPQDVTYAQLHSFTLRQKATEPPPSQEGASPAEPSVYATLAIHSHG

SEQ ID NO: 1865 - protein, 531 aa, Artificial Sequence
  source: /note="Description of Artificial Sequence: Synthetic Chimeric Antigen Receptor sequence"
MALPVTALLLPLALLLHAARPGSGSGAQAAEVQLVESGGGLVQPGRSLRLSCAASGFTFNDYAMHWVRQAPGKGLEWVSTISWNSGSIGYADSVKGRFTISRDNAKKSLYLQMNSLRAEDTALYYCAKDIQYGNYYYGMDVWGQGTTVTVSSGGGGSGGGGSGGGGSEIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTRLEIKRSDPASGAGSGSGSAVHKESGNGHNIWVILVVTLVVPLLLVAVLIVCCCIGSGCGGDPKCMDRVCFWRLGLLRGPGAEDNAHNEILSNADSLSTFVSEQQMESQEPADLTGVTVQSPGEAQCLLGPAEAEGSQRRRLLVPANGADPTETLMLFFDKFANIVPFDSWDQLMRQLDLTKNEIDVVRAGTAGPGDALYAMLMKWVNKTGRNASIHTLLDALERMEERHAKEKIQDLLVDSGKFIYLEDGTGSAVSLESHG

SEQ ID NO: 1866 - protein, 538 aa, Artificial Sequence
  source: /note="Description of Artificial Sequence: Synthetic Chimeric Antigen Receptor sequence"
MALPVTALLLPLALLLHAARPGSGSGAQAAEVQLVESGGGLVQPGRSLRLSCAASGFTFNDYAMHWVRQAPGKGLEWVSTISWNSGSIGYADSVKGRFTISRDNAKKSLYLQMNSLRAEDTALYYCAKDIQYGNYYYGMDVWGQGTTVTVSSGGGGSGGGGSGGGGSEIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTRLEIKRSDPASGAGSGSGSAVHYPPQLLGPSCSWEAEGLHCSCSSQASPAPSLRWWLGEELLEGNSSQGSFEVTPSSAGPWANSSLSLHGGLSSGLRLRCKAWNVHGAQSGSVFQLLPGKLEHGGGLGLGAALGAGVAALLAFCSCLVVFRVKICRKEARKRAAAEQDVPSTLGPISQGHQHECSAGSSQDHPPPGAATYTPGKGEEQELHYASLSFQGLRLWEPADQEAPSTTEYSEIKIHTGQPLRGPGFGLQLEREMSGMVPKSHG

SEQ ID NO: 1867 - protein, 548 aa, Artificial Sequence
  source: /note="Description of Artificial Sequence: Synthetic Chimeric Antigen Receptor sequence"
MALPVTALLLPLALLLHAARPGSGSGAQAAEVQLVESGGGLVQPGRSLRLSCAASGFTFNDYAMHWVRQAPGKGLEWVSTISWNSGSIGYADSVKGRFTISRDNAKKSLYLQMNSLRAEDTALYYCAKDIQYGNYYYGMDVWGQGTTVTVSSGGGGSGGGGSGGGGSEIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTRLEIKRSDPASGAGSGSGSAVHYSPKLLGPSCSWEAEGLHCSCSSQASPAPSLRWWLGEELLEGNSSQDSFEVTPSSAGPWANSSLSLHGGLSSGLRLRCEAWNVHGAQSGSILQLPDKKGLISTAFSNGAFLGIGITALLFLCLALIIMKILPKRRTQTETPRPRFSRHSTILDYINVVPTAGPLAQKRNQKATPNSPRTPLPPGAPSPESKKNQKKQYQLPSFPEPKSSTQAPESQESQEELHYATLNFPGVRPRPEARMPKGTQADYAEVKFQSHG

SEQ ID NO: 1868 - protein, 554 aa, Artificial Sequence
  source: /note="Description of Artificial Sequence: Synthetic Chimeric Antigen Receptor sequence"
MALPVTALLLPLALLLHAARPGSGSGAQAAEVQLVESGGGLVQPGRSLRLSCAASGFTFNDYAMHWVRQAPGKGLEWVSTISWNSGSIGYADSVKGRFTISRDNAKKSLYLQMNSLRAEDTALYYCAKDIQYGNYYYGMDVWGQGTTVTVSSGGGGSGGGGSGGGGSEIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTRLEIKRSDPASGAGSGSGSAVHKESGTKHSGEAPAVEETVTSSPGTPASPCSLSGIIIGVTVAAVVLIVAVFVCKSLLWKKVLPYLKGICSGGGGDPERVDRSSQRPGAEDNVLNEIVSILQPTQVPEQEMEVQEPAEPTGVNMLSPGESEHLLEPAEAERSQRRRLLVPANEGDPTETLRQCFDDFADLVPFDSWEPLMRKLGLMDNEIKVAKAEAAGHRDTLYTMLIKWVNKTGRDASVHTLLDALETLGERLAKQKIEDHLLSSGKFMYLEGNADSAMSSHG

SEQ ID NO: 1869 - protein, 284 aa, Artificial Sequence
  source: /note="Description of Artificial Sequence: Synthetic Chimeric Antigen Receptor sequence"
MALPVTALLLPLALLLHAARPEVQLQQSGPGLVKPSQTLSLTCAISGDSVLSNSDTWNWIRQSPSRGLEWLGRTYHRSTWYDDYASSVRGRVSINVDTSKNQYSLQLNAVTPEDTGAYYCARDRLQDGNSWSDAFDVWGQGTMVTVSSGGGGSGGGGSGGGGSQSALTQPASVSGSPGQSITISCTGTSSDVGGYNYVSWYQQHPGKAPKLMIYDVSNRPSGVSNRFSGSKSGNTASLTISGLQAEDEADYYCSSYTSSSTPYVFGTGTQLTVLGSHHHHHHHH

SEQ ID NO: 1870 - protein, 485 aa, Artificial Sequence
  source: /note="Description of Artificial Sequence: Synthetic Chimeric Antigen Receptor sequence"
MALPVTALLLPLALLLHAARPEVQLVESGGGLVKPGGSLRLSCVASGFTFSNAWMNWVRQAPGKGLEWVGRIKSKTDGGTADYAAPVKGRFTISRDDSKNTMYLQMNSLKTEDTGVYYCITGATDVWGQGTTVTVSSGGGGSGGGGSGGGGSSYVLTQPPSASGTPGQRVTISCSGSSSNIGSNYVYWYQQLPGTAPKLLIYRNNQRPSGVPDRFSGSKSGTSASLAISGLRSEDEADYYCAAWDDSLSGPVFGGGTKLTVLTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1871 - protein, 485 aa, Artificial Sequence
  source: /note="Description of Artificial Sequence: Synthetic Chimeric Antigen Receptor sequence"
MALPVTALLLPLALLLHAARPQVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCARGDYYMDVWGKGTTVTVSSGGGGSGGGGSGGGGSQSALTQPASASGSPGQSVTISCTGTSSDVGGYNYVSWYQQHPGKAPKLMIYEVSKRPSGVPDRFSGSKSGNTASLTISGLQAEDEADYYCSSYTSSGTLVFGGGTKLTVLTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1872 - protein, 486 aa, Artificial Sequence
  source: /note="Description of Artificial Sequence: Synthetic Chimeric Antigen Receptor sequence"
MALPVTALLLPLALLLHAARPQVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCARDLDVSLDIWGQGTMVTVSSGGGGSGGGGSGGGGSQSALTQPASVSGSPGQSITISCSGTSSDVGGYNSVSWYQQYPGKAPKLMIYDVNNRPSGVSSRFSGSKSGNTASLTISGLQAEDEADYYCSSYTSSSTLFFGAGTKVTVLTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1873 - protein, 487 aa, Artificial Sequence
  source: /note="Description of Artificial Sequence: Synthetic Chimeric Antigen Receptor sequence"
MALPVTALLLPLALLLHAARPEVQLVESGAEVKKPGASVKVSCKASGYTFTSYYMHWVRQAPGQGLEWMGIINPSGGSTSYAQKFQGRVTMTRDTSTSTAYMELSSLRSEDTAVYYCAREAGVVAVDYWGQGTLVTVSSGGGGSGGGGSGGGGSQSALTQPASVSGSPGQSITISCTGTSSDVGGYNYVSWYQQHPGKAPKLMIYDVSNRPSGVSNRFSGSKSGNTASLTISGLQAEDEADYYCSSYTSSSTWVFGGGTKLTVLTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1874 - protein, 488 aa, Artificial Sequence
  source: /note="Description of Artificial Sequence: Synthetic Chimeric Antigen Receptor sequence"
MALPVTALLLPLALLLHAARPEVQLVESGAEVKKPGSSVKVSCKASGGTFSSYAISWVRQAPGQGLEWMGGIIPIFGTANYAQKFQGRVTITADESTSTAYMELSSLRSEDTAVYYCARDHKVVRFGYWGQGTLVTVSSGGGGSGGGGSGGGGSHVILTQPPSASASLGASVKLTCTLSSGHSSYAIAWHQQQPEKGPRYLMKVNSDGSLSKGDGIPDRFSGSTSGAERYLTISSLQSEDEADYYCQTWGSGMAIFGGGTKLTVLTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1875 - protein, 488 aa, Artificial Sequence
  source: /note="Description of Artificial Sequence: Synthetic Chimeric Antigen Receptor sequence"
MALPVTALLLPLALLLHAARPQVQLVQSGAEVKKPGASVKVSCKASGYTFTSYYMHWVRQAPGQGLEWMGIINPSGGSTSYAQKFQGRVTMTRDTSISTAYMELSRLRSDDTAVYYCAREMDDSSGPDYWGQGTLVTVSSGGGGSGGGGSGGGGSQSALTQPASVSGSPGQSITISCTGTSSDVGGYNYVSWYQQHPGKAPKLMIYEVSNRPSGVSNRFSGSKSGNTASLTISGLQAEDEADYYCSSYTSSSTLVFGTGTKLTVLTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1876 - protein, 489 aa, Artificial Sequence
  source: /note="Description of Artificial Sequence: Synthetic Chimeric Antigen Receptor sequence"
MALPVTALLLPLALLLHAARPEVQLVESGGGLVQPGRSLRLSCAASGFTFDDYAMHWVRQAPGKGLEWVSGISWNSGSIGYADSVKGRFTISRDNAKNSLYLQMNSLRAEDTALYYCAKDKGGGYYDFWSGSDYWGQGTLVTVSSGGGGSGGGGSGGGGSSSELTQDPAVSVALGQTVRITCQGDSLRSYYASWYQQKPGQAPVLVIYGKNNRPSGIPDRFSGSSSGNTASLTITGAQAEDEADYYCNSRDSSGWVFGGGTKLTVLTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1877 - protein, 489 aa, Artificial Sequence
  source: /note="Description of Artificial Sequence: Synthetic Chimeric Antigen Receptor sequence"
MALPVTALLLPLALLLHAARPQVQLQESGPGLVKPSETLSLTCTVSGGSISSSSYYWGWIRQPPGKGLEWIGSIYYSGSTYYNPSLKSRVTISVDTSKNQFSLKLSSVTAADTAVYYCARGRMDTAMAQIWGQGTMVTVSSGDGGSGGGGSGGGGSNFMLTQPHSVSESPGKTVTIPCTGSSGSFASSYVQWYQQRPGSAPATVIYEDNQRPSGVPDRFSGSVDSSSNSASLTISGLKTEDEAVYYCQSYDGATWVFGGGTKLTVLTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1878 - protein, 489 aa, Artificial Sequence
  source: /note="Description of Artificial Sequence: Synthetic Chimeric Antigen Receptor sequence"
MALPVTALLLPLALLLHAARPQVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCARGSGSLGDAFDIWGQGTMVTVSSGGGGSGGGGSGGGGSQSALTQPASVSGSPGQSITISCTGSSSDVGGYNYVSWYQQHPGKAPKLMIYEVSNRPSGVSNRFSGSKSGNTASLTISGLQAEDEADYYCSSYTSSSTLVFGTGTKVTVLTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1879 - protein, 490 aa, Artificial Sequence
  source: /note="Description of Artificial Sequence: Synthetic Chimeric Antigen Receptor sequence"
MALPVTALLLPLALLLHAARPEVQLVESGGGLVQPGRSLRLSCAASGFTFDDYAMHWVRQAPGKGLEWVSGISWNSGSIGYADSVKGRFTISRDNAKNSLYLQMNSLRAEDTALYYCAKGLSSWHFHDALDIWGQGTMVTVSSGGGGSGGGGSGGGGSSSELTQDPAVSVALGQTVRITCQGDSLRSYYASWYQQKPGQAPVLVIYGKNNRPSGIPDRFSGSSSGNTASLTITGAQAEDEADYYCNSRDSSGNHLWVFGGGTKLTVLTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1880 - protein, 490 aa, Artificial Sequence
  source: /note="Description of Artificial Sequence: Synthetic Chimeric Antigen Receptor sequence"
MALPVTALLLPLALLLHAARPQVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCASFSSSDSYDYWGQGTLVTVSSGGGGSGGGGSGGGGSGGGGSEIVLTQSPATLSVSPGERATLSCRASQSVTSNLAWYQQKPGQAPRLLIYAASTRATGIPARFSGSGSGTEFTLTISSMQSEDFAVYFCQQYHTWPPLTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1881 - protein, 490 aa, Artificial Sequence
  source: /note="Description of Artificial Sequence: Synthetic Chimeric Antigen Receptor sequence"
MALPVTALLLPLALLLHAARPQVQLVQSGAEVKKPGASVKVSCKASGYTFTSYYMHWVRQAPGQGLEWMGIINPSGGSTSYAQKFQGRVTMTRDTSTSTVYMELSSLRAEDTAVYYCARGGYGDYLDAFDIWGQGTTVTVSSGGGGSGGGGSGSGGSQSALTQPASVSGSPGQSITISCTGTSSDVGGYNYVSWYQQHPGKAPKLMIYEVSNRPSGVSNRFSGSKSGNTASLTISGLQAEDEADYYCSSYTSSSTLVFGTGTQLTVLTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1882 - protein, 490 aa, Artificial Sequence
  source: /note="Description of Artificial Sequence: Synthetic Chimeric Antigen Receptor sequence"
MALPVTALLLPLALLLHAARPQVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCARDDDFWSGSGAFDIWGQGTTVTVSSGGGGSGGGGSGGGGSSSELTQDPAVSVALGQTVRITCQGDSLRSYYASWYQQKPGQAPVLVIYGKNNRPSGIPDRFSGSSSGNTASLTITGAQAEDEADYYCNSRDSSGNHPVVFGGGTKLTVLTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1883 - protein, 490 aa, Artificial Sequence
  source: /note="Description of Artificial Sequence: Synthetic Chimeric Antigen Receptor sequence"
MALPVTALLLPLALLLHAARPQVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCARDGFGELSGAFDIWGQGTMVTVSSGGGGSGGGGSGGGGSQSALTQPASVSGSPGQSITISCTGTSSDVGGYNYVSWYQQHPGKAPKLMIYDVSNRPSGVSNRFSGSKSGNTASLTISGLQAEDEADYYCSSYASSSTLVFGGGTKVTVLTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1884 - protein, 490 aa, Artificial Sequence
  source: /note="Description of Artificial Sequence: Synthetic Chimeric Antigen Receptor sequence"
MALPVTALLLPLALLLHAARPQVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCARGSYGDYGDAFDIWGQGTTVTVSSGGGGSGGGGSGSGGSQSALTQPASVSGSPGQSITISCTGTSSDVGGYKYVSWYQQHPGKAPKLMIYDVSNRPSGVSNRFSGSKSGNTASLTISGLQAEDEADYYCSSYTSSSTLVFGGGTKLTVLTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1885 - protein, 491 aa, Artificial Sequence
  source: /note="Description of Artificial Sequence: Synthetic Chimeric Antigen Receptor sequence"
MALPVTALLLPLALLLHAARPEVQLQQSGPGLVKPSLTLSLTCAISGDSVSSNSATWTWIRQSPSRGLEWLGRTYYRSTWYNDYAVSVKSRITINPDTSKNQFSLQLNSVTPEDTAVYYCAREGSGSYYAYWGQGTLVTVSSGGGGSGGGGSGGGGSQSALTQPASVSGSPGQSITISCTGTSSDVGGYNYVSWYQQHPGKAPKLMIYDVSNRPSGVSNRFSGSKSGNTASLTISGLQAEDEADYYCSSYTSSSTLYVFGTGTKVTVLTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1886 - protein, 491 aa, Artificial Sequence
  source: /note="Description of Artificial Sequence: Synthetic Chimeric Antigen Receptor sequence"
MALPVTALLLPLALLLHAARPEVQLVESGAEVKKPGASVKVSCKASGYTFTSYYMHWVRQAPGQGLEWMGIINPSGGSTSYAQKFQGRVTMTRDTSTSTVYMELSSLRSEDTAVYYCARGPIGCSGGSCLDYWGQGTLVTVSSGGGGSGGGGSGGGGSQSALTQPAYVSGSPGQSITISCTGTNSDVGRYNYVSWYQQHPGKAPKLMIYEVSYRPSGVSNRFSGSKSGNTASLTISGLQAEDEADYYCSSYTTSSTLDFGTGTKVTVLTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1887 - protein, 491 aa, Artificial Sequence
  source: /note="Description of Artificial Sequence: Synthetic Chimeric Antigen Receptor sequence"
MALPVTALLLPLALLLHAARPEVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDDFWSGSVDYWGQGTLVTVSSGGGGSGGGGSGGGGSGGGGSSYVLTQPPSVSVAPGKTATITCGGTNIGSKNVHWYQQKPGQAPVLAIYYDSDRPSGIPERFSGSNSGNTATLTISRVEAGDEADYFCQVWDSSSDHWVFGGGTKLTVLTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1888 - protein, 491 aa, Artificial Sequence
  source: /note="Description of Artificial Sequence: Synthetic Chimeric Antigen Receptor sequence"
MALPVTALLLPLALLLHAARPEVQLVESGGGLVQPGGSLRLSCAASGFTFSSYAMHWVRQAPGKGLEYVSAISSNGGSTYYANSVKDRFTISRDNSKNTLYLQMGSLRAEDMAVYYCARVHSSGYYHPGPNDYWGQGTLVTVSSGGGGSGGGGSGGGGSSSELTQDPAVSVALGQTVRITCQGDSLRTYYATWYQQKPGQAPVLVFYDENNRPSGIPDRFSGSSSGNTASLTITGTQAEDEADYYCSSRDSSGNPSCVFGGGTKLTVLTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1889 - protein, 491 aa, Artificial Sequence
  source: /note="Description of Artificial Sequence: Synthetic Chimeric Antigen Receptor sequence"
MALPVTALLLPLALLLHAARPEVQLVESGGGLVQPGGSLRLSCAASGFTFSSYAMSWVRQAPGKGLEWVSYISSSSSTIYYADSVKGRFTISRDNAKNSLYLQMNSLRAEDTAVYYCARDGPIRYFDHSKAFDIWGQGTMVTVSSGGGGSGGGGSGGGGSSSELTQDPAVSVALGQTVRITCQGDSLRSYYASWYQQKPGQAPVLVIYGKNNRPSGIPDRFSGSSSGNTASLTITGAQAEDEADYYRNSRDSSGNPYVFGTGTKVTVLTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1890 - protein, 491 aa, Artificial Sequence
  source: /note="Description of Artificial Sequence: Synthetic Chimeric Antigen Receptor sequence"
MALPVTALLLPLALLLHAARPQVQLVQSGAEVKKPGASVKVSCKASGYTFTGYYMHWVRQAPGQGLEWMGWINPNSGGTNYAQKFQGRVTMTRDTSISTAYMELSRLRSDDTAVYYCARDYWGYYGSGTLDYWGQGTLVTVSSGGGGSGGGGSGGGGSQSALTQPGSVSGSPGQSITISCTGTSSDVGGYNYVSWYQQHPGKAPKLIIYDVSSRPSGVSNRFSGSQSGNTASLTISGLQAEDEADYSCSSYAGSNTLVFGTGTKVTVLTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1891 - protein, 491 aa, Artificial Sequence
  source: /note="Description of Artificial Sequence: Synthetic Chimeric Antigen Receptor sequence"
MALPVTALLLPLALLLHAARPQVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCARDLAAAGNYYYYGMDVWGQGTTVTVSSGGGGSGGGGSGGGGSSSELTQDPAVSVALGQTARITCQGDSLRSYFTSWYHQKPGQAPVLVIYGNNNRPSGIPDRFSGSSSGNTASLTITGAQAEDEGDYYCDSRDSSGDHLVFGGGTKLTVLTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1892 - protein, 492 aa, Artificial Sequence
  source: /note="Description of Artificial Sequence: Synthetic Chimeric Antigen Receptor sequence"
MALPVTALLLPLALLLHAARPQVQLQESGPGLVKPSGTLSLTCAVSGASITSRHWWNWVRHSPGKGLEWIGQIYHSGTTTYNPSLGSRVTISVDKSKNQISLELRSVTAADTATYYCVRDYLELATYYGMDVWGQGTTVTVSSGGGGSGGGGSGGGGSEIVLTQSPLSLPVTPGEPASISCRSSQSLLYSDGYNYLDWYLQKPGQSPQLLIYLGSNRASGVPDRFSGSGSGTDFTLQISGVETEDVGVYYCMQALQTQSFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1893 - protein, 492 aa, Artificial Sequence
  source: /note="Description of Artificial Sequence: Synthetic Chimeric Antigen Receptor sequence"
MALPVTALLLPLALLLHAARPQVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCARPEGVSYYDSSVLDYWGQGTLVTVSSGGGGSGGGGSGGGGSQSALTQPASVSGSPGQSITISCTGTSSDVGGYKHVSWYQHHPGKAPKLMIYDVSNRPSGVSNRFSGSKSGNTASLTVSGLQAEDEAHYYCVSYRNFNSLVFGTGTKVTVLTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1894 - protein, 493 aa, Artificial Sequence
  source: /note="Description of Artificial Sequence: Synthetic Chimeric Antigen Receptor sequence"
MALPVTALLLPLALLLHAARPEVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCAREESSSGWYEGNWFDPWGQGTLVTVSSGGGGSGGGGSGGGGSSSELTQDPAVSVALGQTVRITCQGDSLRSYYASWYQQKPGQAPVLVIYGKNHRPSGIPDRFSGSSSGDTDSLTITGAQAEDEADYYCHSRDSSGNHLFGGGTKLTVLTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1895 - protein, 494 aa, Artificial Sequence
  source: /note="Description of Artificial Sequence: Synthetic Chimeric Antigen Receptor sequence"
MALPVTALLLPLALLLHAARPQVQLQESGPGLVKPSETLSLTCSVSGGSINSYYWSWIRQAPGKGLEWIAFTSHSGNVKYNPSLTGRVTIAVDTSKNQFYLEVTSVTAADTAVYFCARGLDPLFAYDAFEIWGLGTMVTVSSGGGGSGGGGSGGGGSEIVLTQSPLSLPVTPGEPASISCRSSQSLLHSNGYNYLDWYLQKPGQSPQLLIYLGSNRASGVPDRFSGSGSGTDFTLKISRVEAEDVGVYYCMQVLQTPPLTFGGGTKVDIKRTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1896 - protein, 494 aa, Artificial Sequence
  source: /note="Description of Artificial Sequence: Synthetic Chimeric Antigen Receptor sequence"
MALPVTALLLPLALLLHAARPQVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCAREDDSSGYTSPFDYWGQGTLVTVSSGGGGSGGGGSGGGGSGGGRSSYELTQPPSVSVAPGETASIACGGHNIRSKNVHWYQQKPGQAPVLVISYDGDRPSGIPERFSGSNLGSTATLTISRVEAGDEADYYCQVWDSDSDHYVFGTGTKVTVLTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1897 - protein, 494 aa, Artificial Sequence
  source: /note="Description of Artificial Sequence: Synthetic Chimeric Antigen Receptor sequence"
MALPVTALLLPLALLLHAARPQVQLVQSGGGVVQPGRSLRLSCAASGFTFSSYAMSWVRQAPGKGLEWVSAISGSGGSTYYADSVKGRFTISRDNSKNTLYLQMNSLRAEDTAVYYCAKEPLFGVVEEDVDYWGQGTLVTVSSGGGGSGGGGSGGGGSDVVMTQSPLSLPVTPGEPASISCRSSQSLLAGNGHNYLDWYLQKPGQSPQLLIYLGSNRASGVPDRFSGSGSGTDFTLKISRVEAEDVGVYYCMQALQNPLTFGGGTKLEIKRTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1898 - protein, 495 aa, Artificial Sequence
  source: /note="Description of Artificial Sequence: Synthetic Chimeric Antigen Receptor sequence"
MALPVTALLLPLALLLHAARPEVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCARDLGWIAVAGTFDYWGQGTLVTVSSGGGGSGGGGSGGGGSQSALTQPASVSGSPGQSITISCTGTSSDVGGYNYVSWYQQHPGKAPKLMIYDVSKRPSGVSNRFSGSKSGNTASLTISGLQAEDEADYYCSSYTSSSLNHVFGTGTKVTVLTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1899 - protein, 495 aa, Artificial Sequence
  source: /note="Description of Artificial Sequence: Synthetic Chimeric Antigen Receptor sequence"
MALPVTALLLPLALLLHAARPQVQLVQSGGGLIQPGGSLRLSCAASGFTVSSNYMSWVRQAPGKGLEWVSVIYSGGSTYYADSVKGRFTISRDNSKNTLYLQMNSLRAEDTAVYYCASQSTPYDSSGYYSGDAFDIWGQGTMVTVSSGGGGSGGGGSGGGGSSYVLTQPPSASGTPGQRVTISCSGSSSNIGSNYVYWYQQLPGTAPKLLIYRNNQRPSGVPDRFSGSKSGTSASLAISGLRSEDEADYYCAAWDDSLSGYVFGTGTKLTVLTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1900 - protein, 496 aa, Artificial Sequence
  source: /note="Description of Artificial Sequence: Synthetic Chimeric Antigen Receptor sequence"
MALPVTALLLPLALLLHAARPEVQLVESGAEVKKPGESLKISCKGSGYSFTGSWIGWGRQMPGKGLEWMGIIYPGDSDTRYSPSFQGQVTISADKSISTAYLQWSSLKASDTAMYYCARGFLRGGDCCGALDIWGQGTMVTVSSGGGGSGGGGSGGGGSDIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPPWTFGQGTKLEIKRTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1901 - protein, 496 aa, Artificial Sequence
  source: /note="Description of Artificial Sequence: Synthetic Chimeric Antigen Receptor sequence"
MALPVTALLLPLALLLHAARPQVQLVQSGAEVKKPGASVKVSCKASGYTFTSYDINWVRQATGQGLEWMGWMNPNSGNTGYAQKFQGRVTMTRNTSISTAYMELSSLRSEDTAVYYCARGDSNYWSYYGMDVWGQGTLVTVSSGGGGSGGGGSGGGGSGGGGSQSVLTQPRSVSGSPGQSVTISCTGTSSDVGGYNYVSWYQQHPGEAPKLIIYDADKRPSGISNRFSSGKSGNTASLTISGLQVEDEADYYCCSYAGGSTWVFGGGTKVTVLTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1902 - protein, 497 aa, Artificial Sequence
  source: /note="Description of Artificial Sequence: Synthetic Chimeric Antigen Receptor sequence"
MALPVTALLLPLALLLHAARPEVQLQQSGPGLVKPSQTLSLTCAISGDSVLSNSDTWNWIRQSPSRGLEWLGRTYHRSTWYDDYASSVRGRVSINVDTSKNQYSLQLNAVTPEDTGVYYCARDRLQDGNSWSDAFDVWGQGTMVTVSSGGGGSGGGGSGGGGSQSALTQPASASGSPGQSVTISCTGTSSDVGGYNYVSWYQQHPGKAPKLMIYDVSNRPSGVSNRFSGSKSGNTASLTISGLQAEDEADYYCSSYTSSSTLYVFGTGTQLTVLTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1903 - protein, 498 aa, Artificial Sequence
  source: /note="Description of Artificial Sequence: Synthetic Chimeric Antigen Receptor sequence"
MALPVTALLLPLALLLHAARPEVQLQQSGPGLVKPSQTLSLTCAISGDSVLSNSDTWNWIRQSPSRGLEWLGRTYHRSTWYDDYASSVRGRVSINVDTSKNQYSLQLNAVTPEDTGVYYCARDRLQDGNSWSDAFDVWGQGTMVTVSSGGGGSGGGGSGGGGSQSALTQPASVSGSPGQSITISCTGTSSDVGGYNYVSWYQQHPGKAPKLMIYDVSNRPSGVSNRFSGSKSGNTASLTISGLQAEDEADYYCSSYTSSSTLVYVFGTGTKVTVLTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1904 - protein, 498 aa, Artificial Sequence
  source: /note="Description of Artificial Sequence: Synthetic Chimeric Antigen Receptor sequence"
MALPVTALLLPLALLLHAARPEVQLQQSGPGLVKPSQTLSLTCAISGDSVSSNSAAWNWIRQSPSRGLEWLGRTYYRSKWYSDYAVSVKSRITINPDTSKNQFSLQLNSVTPEDTAVYYCARDPYDFWSGYPDAFDIWGQGTMVTVSSGGGGSGGGGSGGGGSQSALTQPASVSGSPGQSITISCTGTSSDVGGYNYVSWYQQHPGKAPKVIISEVNNRPSGVSHRFSGSKSGNTASLTISGLQAEDEADYFCSSYTSGRTLYVFGTGSKVTVLGTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1905 - protein, 498 aa, Artificial Sequence
  source: /note="Description of Artificial Sequence: Synthetic Chimeric Antigen Receptor sequence"
MALPVTALLLPLALLLHAARPQVNLRESGPALVKPTQTLTLTCTFSGFSLNTFGMSVSWIRQPPGKALEWLALIDWDDDKYYSTSLRTRLTISKDTAKNQVVLRMTNMDPMDTATYYCARIYGGDRTNTQAPYFFDLWGQGTLVTVSSGGGGSGGGGSGGGGSDVVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPWTFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1906 - protein, 498 aa, Artificial Sequence
  source: /note="Description of Artificial Sequence: Synthetic Chimeric Antigen Receptor sequence"
MALPVTALLLPLALLLHAARPQVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCARAGLALYSNYVPYYYYGMDVWGQGTTVTVSSGGGGSGGGGSGGGGSNFMLTQPHSVSESPGKTVTISCTRSSGSIASNYVQWYQQRPGSSPTTVIYEDNQRPSGVPDRFSGSIDSSSNSASLTISGLKTEDEADYYCQSYDSSNPWVFGGGTKLTVLTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1907 - protein, 525 aa, Artificial Sequence
  source: /note="Description of Artificial Sequence: Synthetic Chimeric Antigen Receptor sequence"
MALPVTALLLPLALLLHAARPDIQMTQSPSSLSASVGDRVTITCSASSSVSYMNWYQQTPGKAPKRWIYDTSKLASGVPSRFSGSGSGTDYTFTISSLQPEDIATYYCQQWSSNPFTFGQGTKLQIGGGGSGGGGSGGGGSQVQLVQSGGGVVQPGRSLRLSCKASGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSTTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSKRGRKKLLYIFKQPFMRPVQTTQEEDGCSCRFPEEEEGGCELRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPR

SEQ ID NO: 1908 - protein, 711 aa, Artificial Sequence
  source: /note="Description of Artificial Sequence: Synthetic Chimeric Antigen Receptor sequence"
DIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSQVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCAREVTGDLEDAFDIWGQGTMVTVSSGSTSGSGKPGSGEGSTKGDIQMTQSPSSLSASVGDRVTITCRASQTIWSYLNWYQQRPGKAPNLLIYAASSLQSGVPSRFSGRGSGTDFTLTISSLQAEDFATYYCQQSYSIPQTFGQGTKLEIKGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSSGTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1909 - protein, 792 aa, Artificial Sequence [sequence omitted]

SEQ ID NO: 1910 - protein, 727 aa, Artificial Sequence
  source: /note="Description of Artificial Sequence: Synthetic Chimeric Antigen Receptor sequence"
MVLLVTSLLLCELPHPAFLLIPDTEVQLVESGGGLVKPGGSLKLSCAASGFAFSIYDMSWVRQTPEKRLEWVAYISSGGGTYYPDTVKGRFTISRDNAKNTLYLQMSSLKSEDTAMYYCARHSGYGSSYGVLFAYWGQGTLVTVSAGGGGSGGGGSGGGGSDIQMTQTTSSLSASLGDRVTISCRASQDISNYLNWYQQKPDGTVKLLIYYTSILHSGVPSRFSGSGSGTDYSLTISNLEQEDFATYFCQQGNTLPWTFGGGTKLEIKAEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKKDPKAAAIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1911 - protein, 792 aa, Artificial Sequence
  source: /note="Description of Artificial Sequence: Synthetic Chimeric Antigen Receptor sequence"
MVLLVTSLLLCELPHPAFLLIPDTEVQLVESGGGLVKPGGSLKLSCAASGFAFSIYDMSWVRQTPEKRLEWVAYISSGGGTYYPDTVKGRFTISRDNAKNTLYLQMSSLKSEDTAMYYCARHSGYGTHWGVLFAYWGQGTLVTVSAGGGGSGGGGSGGGGSDIQMTQTTSSLSASLGDRVTISCRASQDISNYLNWYQQKPDGTVKLLIYYTSILHSGVPSRFSGSGSGTDYSLTISNLEQEDFATYFCQQGNTLPWTFGGGTKLEIKAEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKKDPKAAAAFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1912 - protein, 511 aa, Artificial Sequence
  source: /note="Description of Artificial Sequence: Synthetic Chimeric Antigen Receptor sequence"
MVLLVTSLLLCELPHPAFLLIPDTEVQLVESGGGLVKPGGSLKLSCAASGFAFSIYDMSWVRQTPEKRLEWVAYISSGGGTYYPDTVKGRFTISRDNAKNTLYLQMSSLKSEDTAMYYCARHSGYGTHWGVLFAYWGQGTLVTVSAGGGGSGGGGSGGGGSDIQMTQTTSSLSASLGDRVTISCRASQDISNYLNWYQQKPDGTVKLLIYYTSILHSGVPSRFSGSGSGTDYSLTISNLEQEDFATYFCQQGNTLPWTFGGGTKLEIKAKTTPPSVYGRVKDPKAAAATTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1913 - protein, 571 aa, Artificial Sequence
  source: /note="Description of Artificial Sequence: Synthetic Chimeric Antigen Receptor sequence"
MVLLVTSLLLCELPHPAFLLIPDTEVQLVESGGGLVKPGGSLKLSCAASGFAFSIYDMSWVRQTPEKRLEWVAYISSGGGTYYPDTVKGRFTISRDNAKNTLYLQMSSLKSEDTAMYYCARHSGYGTHWGVLFAYWGQGTLVTVSAGGGGSGGGGSGGGGSDIQMTQTTSSLSASLGDRVTISCRASQDISNYLNWYQQKPDGTVKLLIYYTSILHSGVPSRFSGSGSGTDYSLTISNLEQEDFATYFCQQGNTLPWTFGGGTKLEIKAKTTPPSVYGRVKDPKAAAAFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1914 - protein, 506 aa, Artificial Sequence
  source: /note="Description of Artificial Sequence: Synthetic Chimeric Antigen Receptor sequence"
MVLLVTSLLLCELPHPAFLLIPDTEVQLVESGGGLVKPGGSLKLSCAASGFAFSIYDMSWVRQTPEKRLEWVAYISSGGGTYYPDTVKGRFTISRDNAKNTLYLQMSSLKSEDTAMYYCARHSGYGTHWGVLFAYWGQGTLVTVSAGGGGSGGGGSGGGGSDIQMTQTTSSLSASLGDRVTISCRASQDISNYLNWYQQKPDGTVKLLIYYTSILHSGVPSRFSGSGSGTDYSLTISNLEQEDFATYFCQQGNTLPWTFGGGTKLEIKAKTTPPSVYGRVKDPKAAAIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1915 - protein, 480 aa, Artificial Sequence
  source: /note="Description of Artificial Sequence: Synthetic Chimeric Antigen Receptor sequence"
MLLLVTSLLLCELPHPAFLLIPQVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCAREVTGDLEDAFDIWGQGTMVTVSSGGGGSDIQMTQSPSSLSASVGDRVTITCRASQTIWSYLNWYQQRPGKAPNLLIYAASSLQSGVPSRFSGRGSGTDFTLTISSLQAEDFATYYCQQSYSIPQTFGQGTKLEIKAAAIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1916 - protein, 484 aa, Artificial Sequence
  source: /note="Description of Artificial Sequence: Synthetic Chimeric Antigen Receptor sequence"
MLLLVTSLLLCELPHPAFLLIPQVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCAREVTGDLEDAFDIWGQGTMVTVSSGGGGSDIQMTQSPSSLSASVGDRVTITCRASQTIWSYLNWYQQRPGKAPNLLIYAASSLQSGVPSRFSGRGSGTDFTLTISSLQAEDFATYYCQQSYSIPQTFGQGTKLEIKAAATTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1917 - protein, 544 aa, Artificial Sequence
  source: /note="Description of Artificial Sequence: Synthetic Chimeric Antigen Receptor sequence"
MLLLVTSLLLCELPHPAFLLIPQVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCAREVTGDLEDAFDIWGQGTMVTVSSGGGGSDIQMTQSPSSLSASVGDRVTITCRASQTIWSYLNWYQQRPGKAPNLLIYAASSLQSGVPSRFSGRGSGTDFTLTISSLQAEDFATYYCQQSYSIPQTFGQGTKLEIKAAAFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1918 - protein, 729 aa, Artificial Sequence
  source: /note="Description of Artificial Sequence: Synthetic Chimeric Antigen Receptor sequence"
QVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCAREVTGDLEDAFDIWGQGTMVTVSSGGGGSDIQMTQSPSSLSASVGDRVTITCRASQTIWSYLNWYQQRPGKAPNLLIYAASSLQSGVPSRFSGRGSGTDFTLTISSLQAEDFATYYCQQSYSIPQTFGQGTKLEIKGGGGSGGGGSGGGGSGGGGSGGGGSDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGSTSGSGKPGSGEGSTKGEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1919 - protein, 737 aa, Artificial Sequence
  source: /note="Description of Artificial Sequence: Synthetic Chimeric Antigen Receptor sequence"
EVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCARDLGWIAVAGTFDYWGQGTLVTVSSGGGGSGGGGSGGGGSQSALTQPASVSGSPGQSITISCTGTSSDVGGYNYVSWYQQHPGKAPKLMIYDVSKRPSGVSNRFSGSKSGNTASLTISGLQAEDEADYYCSSYTSSSLNHVFGTGTKVTVLTGGGGSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1920 - protein, 703 aa, Artificial Sequence
  source: /note="Description of Artificial Sequence: Synthetic Chimeric Antigen Receptor sequence"
QVQLQQSGAEVKKPGSSVKVSCKASGGTFSSYAISWVRQAPGQGLEWMGGIIPILGIANYAQKFQGRVTITADESTSTAYMELSSLRSEDTAVYYCATGGSGRYALDIWGQGTMVTVSSGGGGSGGGGSGGGGSEIVLTQSPATLSLSPGERATLSCRASQSVSSYLAWYQQKPGQAPRLLIYDASNRATGIPARFSGSGSGTDFTLTISSLEPEDFAVYYCQQRSNWPPSYTFGQGTKLEIKRAEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKKDPKAAAIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1921 - protein, 223 aa, Artificial Sequence
  source: /note="Description of Artificial Sequence: Synthetic Chimeric Antigen Receptor sequence"
TTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1922 - protein, 470 aa, Artificial Sequence
  source: /note="Description of Artificial Sequence: Synthetic Chimeric Antigen Receptor sequence"
QVQLQQSGAEVKKPGSSVKVSCKASGGTFSSYAISWVRQAPGQGLEWMGGIIPILGIANYAQKFQGRVTITADESTSTAYMELSSLRSEDTAVYYCARGGAGGSGSYYPLIWGQGTTVTVSSGGGGSGGGGSGGGGSEIVLTQSPATLSLSPGERATLSCGASQSVSSSYLAWYQQKPGQAPRLLIYDASSRATGIPARFSGSGSGTDFTLTISSLEPEDFAVYYCQQRSSWPPTWTFGQGTKLEIKRAAAIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1923 - protein, 705 aa, Artificial Sequence
  source: /note="Description of Artificial Sequence: Synthetic Chimeric Antigen Receptor sequence"
QVQLVQSGAEVKKPGSSVKVSCKASGGTFSSYAISWVRQAPGQGLEWMGGIIPILGTANYAQKFQGRVTITADESTSTAYMELSSLRSEDTAVYYCARWGGGAFDIWGQGTMVTVSSGGGGSGGGGSGGGGSEIVLTQSPGTLSLSPGERATLSCRASQSVGGYLAWYQQKPGQAPRLLIYDASNRATGIPARFSGSGSGTDFTLTISSLEPEDFAVYYCQQRNNWPPMYTFGQGTKLEIKRAEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKKDPKAAATTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1924 - protein, 707 aa, Artificial Sequence
  source: /note="Description of Artificial Sequence: Synthetic Chimeric Antigen Receptor sequence"
QVQLQQSGAEVKKPGSSVKVSCKASGGTFSSYAISWVRQAPGQGLEWMGGIIPILGIANYAQKFQGRVTITADESTSTAYMELSSLRSEDTAVYYCATGGSGRYALDIWGQGTMVTVSSGGGGSGGGGSGGGGSEIVLTQSPATLSLSPGERATLSCRASQSVSSYLAWYQQKPGQAPRLLIYDASNRATGIPARFSGSGSGTDFTLTISSLEPEDFAVYYCQQRSNWPPSYTFGQGTKLEIKRAEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKKDPKAAATTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1925 - protein, 711 aa, Artificial Sequence
  source: /note="Description of Artificial Sequence: Synthetic Chimeric Antigen Receptor sequence"
QVQLQQSGAEVKKPGSSVKVSCKASGGTFSSYAISWVRQAPGQGLEWMGGIIPILGIANYAQKFQGRVTITADESTSTAYMELSSLRSEDTAVYYCARGGAGGSGSYYPLIWGQGTTVTVSSGGGGSGGGGSGGGGSEIVLTQSPATLSLSPGERATLSCGASQSVSSSYLAWYQQKPGQAPRLLIYDASSRATGIPARFSGSGSGTDFTLTISSLEPEDFAVYYCQQRSSWPPTWTFGQGTKLEIKRAEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKKDPKAAATTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1926 - protein, 765 aa, Artificial Sequence
  source: /note="Description of Artificial Sequence: Synthetic Chimeric Antigen Receptor sequence"
QVQLVQSGAEVKKPGSSVKVSCKASGGTFSSYAISWVRQAPGQGLEWMGGIIPILGTANYAQKFQGRVTITADESTSTAYMELSSLRSEDTAVYYCARWGGGAFDIWGQGTMVTVSSGGGGSGGGGSGGGGSEIVLTQSPGTLSLSPGERATLSCRASQSVGGYLAWYQQKPGQAPRLLIYDASNRATGIPARFSGSGSGTDFTLTISSLEPEDFAVYYCQQRNNWPPMYTFGQGTKLEIKRAEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKKDPKAAAFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1927 - protein, 767 aa, Artificial Sequence
  source: /note="Description of Artificial Sequence: Synthetic Chimeric Antigen Receptor sequence"
QVQLQQSGAEVKKPGSSVKVSCKASGGTFSSYAISWVRQAPGQGLEWMGGIIPILGIANYAQKFQGRVTITADESTSTAYMELSSLRSEDTAVYYCATGGSGRYALDIWGQGTMVTVSSGGGGSGGGGSGGGGSEIVLTQSPATLSLSPGERATLSCRASQSVSSYLAWYQQKPGQAPRLLIYDASNRATGIPARFSGSGSGTDFTLTISSLEPEDFAVYYCQQRSNWPPSYTFGQGTKLEIKRAEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKKDPKAAAFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1928 - protein, 771 aa, Artificial Sequence
  source: /note="Description of Artificial Sequence: Synthetic Chimeric Antigen Receptor sequence"
QVQLQQSGAEVKKPGSSVKVSCKASGGTFSSYAISWVRQAPGQGLEWMGGIIPILGIANYAQKFQGRVTITADESTSTAYMELSSLRSEDTAVYYCARGGAGGSGSYYPLIWGQGTTVTVSSGGGGSGGGGSGGGGSEIVLTQSPATLSLSPGERATLSCGASQSVSSSYLAWYQQKPGQAPRLLIYDASSRATGIPARFSGSGSGTDFTLTISSLEPEDFAVYYCQQRSSWPPTWTFGQGTKLEIKRAEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKKDPKAAAFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1929 - protein, 906 aa, Artificial Sequence
  source: /note="Description of Artificial Sequence: Synthetic Chimeric Antigen Receptor sequence"
QVQLQQWGAGLLKPSETLSLTCAVYGGSFSAYYWSWIRQPPGKGLEWIGDINHGGGTNYNPSLKSRVTISVDTSKNQFSLKLNSVTAADTAVYYCASLTAYWGQGSLVTVSSGSTSGSGKPGSSEGSTKGDIQMTQSPTSLSASVGDRVTITCRASQGISSWLTWYQQKPEKAPKSLIYAASSLQSGVPSRFSGSGSGTDFTLTISSLQPEDFATYYCQQYDSYPITFGQGTRLEIKGSTSGSGKPGSSEGSTKGFWVLVVVGGVLACYSLLVTVAFIIFWVKRGRKKLLYIFKQPFMRPVQTTQEEDGCSCRFPEEEEGGCELQRRKYRSNKGESPVEPAEPCHYSCPREEEGSTIPIQEDYRKPEPACSPGSTSGSGKPGSSEGSTKGRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSTSGSGKPGSSEGSTKGVGALESLRGNADLAYILSMEPCGHCLIINNVNFCRESGLRTRTGSNIDCEKLRRRFSSLHFMVEVKGDLTAKKMVLALLELAQQDHGALDCCVVVILSHGCQASHLQFPGAVYGTDGCPVSVEKIVNIFNGTSCPSLGGKPKLFFIQACGGEQKDHGFEVASTSPEDESPGSNPEPDATPFQEGLRTFDQLDAISSLPTPSDIFVSYSTFPGFVSWRDPKSGSWYVETLDDIFEQWAHSEDLQSLLLRVANAVSVKGIYKQMPGCFNFLRKKLFFKTSMGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 1930 - protein, 470 aa, Artificial Sequence; identical to SEQ ID NO: 1922
  source: /note="Description of Artificial Sequence: Synthetic Chimeric Antigen Receptor sequence"

SEQ ID NO: 1931 - protein, 474 aa, Artificial Sequence
  source: /note="Description of Artificial Sequence: Synthetic Chimeric Antigen Receptor sequence"
QVQLQQSGAEVKKPGSSVKVSCKASGGTFSSYAISWVRQAPGQGLEWMGGIIPILGIANYAQKFQGRVTITADESTSTAYMELSSLRSEDTAVYYCARGGAGGSGSYYPLIWGQGTTVTVSSGGGGSGGGGSGGGGSEIVLTQSPATLSLSPGERATLSCGASQSVSSSYLAWYQQKPGQAPRLLIYDASSRATGIPARFSGSGSGTDFTLTISSLEPEDFAVYYCQQRSSWPPTWTFGQGTKLEIKRAAATTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1932 - protein, 534 aa, Artificial Sequence
  source: /note="Description of Artificial Sequence: Synthetic Chimeric Antigen Receptor sequence"
QVQLQQSGAEVKKPGSSVKVSCKASGGTFSSYAISWVRQAPGQGLEWMGGIIPILGIANYAQKFQGRVTITADESTSTAYMELSSLRSEDTAVYYCARGGAGGSGSYYPLIWGQGTTVTVSSGGGGSGGGGSGGGGSEIVLTQSPATLSLSPGERATLSCGASQSVSSSYLAWYQQKPGQAPRLLIYDASSRATGIPARFSGSGSGTDFTLTISSLEPEDFAVYYCQQRSSWPPTWTFGQGTKLEIKRAAAFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1933 - protein, 714 aa, Artificial Sequence
  source: /note="Description of Artificial Sequence: Synthetic Chimeric Antigen Receptor sequence"
QVQLQQSGAEVKKPGSSVKVSCKASGGTFSSYAISWVRQAPGQGLEWMGGIIPILGIANYAQKFQGRVTITADESTSTAYMELSSLRSEDTAVYYCARGGAGGSGSYYPLIWGQGTTVTVSSGGGGSGGGGSGGGGSEIVLTQSPATLSLSPGERATLSCGASQSVSSSYLAWYQQKPGQAPRLLIYDASSRATGIPARFSGSGSGTDFTLTISSLEPEDFAVYYCQQRSSWPPTWTFGQGTKLEIKRAEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKKDPKAAAIEGAAAAIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1934 - protein, 464 aa, Artificial Sequence
  source: /note="Description of Artificial Sequence: Synthetic Chimeric Antigen Receptor sequence"
QVQLVQSGAEVKKPGSSVKVSCKASGGTFSSYAISWVRQAPGQGLEWMGGIIPILGTANYAQKFQGRVTITADESTSTAYMELSSLRSEDTAVYYCARWGGGAFDIWGQGTMVTVSSGGGGSGGGGSGGGGSEIVLTQSPGTLSLSPGERATLSCRASQSVGGYLAWYQQKPGQAPRLLIYDASNRATGIPARFSGSGSGTDFTLTISSLEPEDFAVYYCQQRNNWPPMYTFGQGTKLEIKRAAAIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1935 - protein, 468 aa, Artificial Sequence
  source: /note="Description of Artificial Sequence: Synthetic Chimeric Antigen Receptor sequence"
QVQLVQSGAEVKKPGSSVKVSCKASGGTFSSYAISWVRQAPGQGLEWMGGIIPILGTANYAQKFQGRVTITADESTSTAYMELSSLRSEDTAVYYCARWGGGAFDIWGQGTMVTVSSGGGGSGGGGSGGGGSEIVLTQSPGTLSLSPGERATLSCRASQSVGGYLAWYQQKPGQAPRLLIYDASNRATGIPARFSGSGSGTDFTLTISSLEPEDFAVYYCQQRNNWPPMYTFGQGTKLEIKRAAATTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1936 - protein, 528 aa, Artificial Sequence
  source: /note="Description of Artificial Sequence: Synthetic Chimeric Antigen Receptor sequence"
QVQLVQSGAEVKKPGSSVKVSCKASGGTFSSYAISWVRQAPGQGLEWMGGIIPILGTANYAQKFQGRVTITADESTSTAYMELSSLRSEDTAVYYCARWGGGAFDIWGQGTMVTVSSGGGGSGGGGSGGGGSEIVLTQSPGTLSLSPGERATLSCRASQSVGGYLAWYQQKPGQAPRLLIYDASNRATGIPARFSGSGSGTDFTLTISSLEPEDFAVYYCQQRNNWPPMYTFGQGTKLEIKRAAAFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1937 - protein, 701 aa, Artificial Sequence
  source: /note="Description of Artificial Sequence: Synthetic Chimeric Antigen Receptor sequence"
QVQLVQSGAEVKKPGSSVKVSCKASGGTFSSYAISWVRQAPGQGLEWMGGIIPILGTANYAQKFQGRVTITADESTSTAYMELSSLRSEDTAVYYCARWGGGAFDIWGQGTMVTVSSGGGGSGGGGSGGGGSEIVLTQSPGTLSLSPGERATLSCRASQSVGGYLAWYQQKPGQAPRLLIYDASNRATGIPARFSGSGSGTDFTLTISSLEPEDFAVYYCQQRNNWPPMYTFGQGTKLEIKRAEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKKDPKAAAIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1938 - protein, 466 aa, Artificial Sequence
  source: /note="Description of Artificial Sequence: Synthetic Chimeric Antigen Receptor sequence"
QVQLQQSGAEVKKPGSSVKVSCKASGGTFSSYAISWVRQAPGQGLEWMGGIIPILGIANYAQKFQGRVTITADESTSTAYMELSSLRSEDTAVYYCATGGSGRYALDIWGQGTMVTVSSGGGGSGGGGSGGGGSEIVLTQSPATLSLSPGERATLSCRASQSVSSYLAWYQQKPGQAPRLLIYDASNRATGIPARFSGSGSGTDFTLTISSLEPEDFAVYYCQQRSNWPPSYTFGQGTKLEIKRAAAIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1939 - protein, 470 aa, Artificial Sequence
  source: /note="Description of Artificial Sequence: Synthetic Chimeric Antigen Receptor sequence"
QVQLQQSGAEVKKPGSSVKVSCKASGGTFSSYAISWVRQAPGQGLEWMGGIIPILGIANYAQKFQGRVTITADESTSTAYMELSSLRSEDTAVYYCATGGSGRYALDIWGQGTMVTVSSGGGGSGGGGSGGGGSEIVLTQSPATLSLSPGERATLSCRASQSVSSYLAWYQQKPGQAPRLLIYDASNRATGIPARFSGSGSGTDFTLTISSLEPEDFAVYYCQQRSNWPPSYTFGQGTKLEIKRAAATTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1940 - protein, 530 aa, Artificial Sequence
  source: /note="Description of Artificial Sequence: Synthetic Chimeric Antigen Receptor sequence"
QVQLQQSGAEVKKPGSSVKVSCKASGGTFSSYAISWVRQAPGQGLEWMGGIIPILGIANYAQKFQGRVTITADESTSTAYMELSSLRSEDTAVYYCATGGSGRYALDIWGQGTMVTVSSGGGGSGGGGSGGGGSEIVLTQSPATLSLSPGERATLSCRASQSVSSYLAWYQQKPGQAPRLLIYDASNRATGIPARFSGSGSGTDFTLTISSLEPEDFAVYYCQQRSNWPPSYTFGQGTKLEIKRAAAFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1941 - protein, 496 aa, Artificial Sequence
  source: /note="Description of Artificial Sequence: Synthetic Chimeric Antigen Receptor sequence"
MVATLLVTSLLLCELPHPAFLLIPDTEVQLVESGGGLVQPGGSLRLSCAASGFTFSSFGMHWVRQAPGKGLEWVAYISSDSSAIYYADTVKGRFTISRDNAKNSLYLQMNSLRDEDTAVYYCGRGRENIYYGSRLDYWGQGTTVTVSSGGGGSGGGGSGGGGSDIQLTQSPSFLSASVGDRVTITCKASQNVDTNVAWYQQKPGKAPKALIYSASYRYSGVPSRFSGSGSGTDFTLTISSLQPEDFATYYCQQYNNYPFTFGQGTKLEIKAAATTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1942 - protein, 978 aa, Artificial Sequence
  source: /note="Description of Artificial Sequence: Synthetic Chimeric Antigen Receptor sequence"
MDFQVQIFSFLLISASVIMSRMAQVQLQQSGAELARPGASVKMSCKASGYTFTTYTIHWVRRRPGHDLEWIGYINPSSGCSDYNQNFKGKTTLTADKSSNTAYMQLNSLTSEDSAVYYCARRADYGNYEYTWFAYWGQGTTVTVSSSGGGSGGGGSGGGGSVIELTQSPKFMSTSVGDRVNVTYKASQNVGTNVAWFQQKPGQSPKVLIYSASYRYSGVPDRFTGSGSGTDFTLTISNVQSEDLAEYFCQQYHTYPLTFGGGTKLEIKRAAAGGGGSGGGGSGGGGSGGGGSGGGGSGGGGSGGGGSGGGGSVDMAQVQLQESGGGLVQPGGSLKLSCAASGFTFSSYGMSWVRQTPDKRLELVATINSNGGSTYYPDSVKGRFTISRDNAKNTLYLQMSSLKSEDTAMYYCARDRDGYDEGFDYWGQGTTVTVSSGGGGSGGGGSGGGGSDIELTQSPSIMSASPGEKVTMTCSASSSVSYMHWYQQKSGTSPKRWIYDTSKLASGVPARFSGSGSGTSYSLTISSMEAEDAATYYCQQWSSNPPTLGRRTQLQLKRADPAEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKKDPKFWVLVVVGGVLACYSLLVTVAFIIFWVRSKRSRLLHSDYMNMTPRRPGPTRKHYQAYAAARDFAAYRSLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1943 - protein, 252 aa, Artificial Sequence; identical to SEQ ID NO: 354
  source: /note="Description of Artificial Sequence: Synthetic Chimeric Antigen Receptor sequence"

SEQ ID NO: 1944 - protein, 494 aa, Artificial Sequence
  source: /note="Description of Artificial Sequence: Synthetic Chimeric Antigen Receptor sequence"
MALPVTALLLPLALLLHAARPQVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARLGGSLPDYGMDVWGQGTMVTVSSASGGGGSGGGGSGGGGSEIVLTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTLITFGQGTKVDIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1945 - protein, 527 aa, Artificial Sequence
  source: /note="Description of Artificial Sequence: Synthetic Chimeric Antigen Receptor sequence"
GSATMAADSQTPWLLTFSLLCLLWPQEAGALPLLHESGAEVAKPGASVKMSCKASGYTFTTYWMHWIKQRPGQGLEWIGYINPSTGYTDYNQNFKDKATLTADKSSRTAYMQLSSLTSEDSTVYYCTRRGPSYGNHGAWFPYWGQGTLVTVSAVSSGGGGSGGGGSGGGGSTNIVMTQSPRSMSMSVGERVTLSCKASENVDTYVSWYQQKPEQSPKLLIYGASNRYTGVPDRFTGSGSATDFTLTISSVQAEDLADYHCGQSYRYPPTFGGGTKLEITRLSNSIMYFSHFVPVFLPAKPTTTPAPRPPTPAPTIASQPLSLRPEACRPAAGGAVHTRGLDFACDIYIWAPLAGTCGVLLLSLVITLYCRSKRGRKKLLYIFKQPFMRPVQTTQEEDGCSCRFPEEEEGGCELEFRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1946 - protein, 442 aa, Artificial Sequence
  source: /note="Description of Artificial Sequence: Synthetic Chimeric Antigen Receptor sequence"
PLALLLHAARPEVQLLESGGGLVQPGGSLRLSCAVSGFTFNSFAMSWVRQAPGKGLEWVSAISGSGGGTYYADSVKGRFTISRDNSKNTLYLQMNSLRAEDTAVYFCAKDKILWFGEPVFDYWGQGTLVTVSSASGGGGSGGGGSGGGGSEIVLTQSPATLSLSPGERATLSCRASQSVSSYLAWYQQKPGQAPRLLIYDASNRATGIPARFSGSGSGTDFTLTISSLEPEDFAVYYCQQRSNWPPTFGQGTKVEIKGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDA

SEQ ID NO: 1947 - protein, 455 aa, Artificial Sequence
  source: /note="Description of Artificial Sequence: Synthetic Chimeric Antigen Receptor sequence"
MALPVTALLLPLALLLHAARPQVQLQQSGPELVRPGTFVKISCKASGYTFTNYDINWVNQRPGQGLEWIGWIYPGDGSTKYNEKFKAKATLTADKSSSTAYLQLNNLTSENSAVYFCASGYEDAMDYWGQGTSVTVSSGGGGSGGGGSGGGGSDIKMTQSPSSMYASLGERVIINCKASQDINSYLSWFQQKPGKSPKTLIYRANRLVDGVPSRFSGSGSGQDYSLTISSLEYEDMGIYYCLQYDEFPLTFGAGTKLELKRGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1948 - protein, 457 aa, Artificial Sequence
  source: /note="Description of Artificial Sequence: Synthetic Chimeric Antigen Receptor sequence"
MALPVTALLLPLALLLHAARPEVQLQQSGPELVKPGASVKISCKASGYTFTDYNMHWVKQSHGKSLEWIGYIYPYNGGTGYNQKFKSKATLTVDNSSSTAYMDVRSLTSEDSAVYYCARGRPAMDYWGQGTSVTVSSGGGGSGGGGSGGGGSDIVLTQSPASLAVSLGQRATISCRASESVDNYGISFMNWFQQKPGQPPKLLIYAASNQGSGVPARFSGSGSGTDFSLNIHPMEEDDTAMYFCQQSKEVPWTFGGGTKLEIKGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1949 - protein, 458 aa, Artificial Sequence
  source: /note="Description of Artificial Sequence: Synthetic Chimeric Antigen Receptor sequence"
MALPVTALLLPLALLLHAARPQVQLQQSGPELVRPGTFVKISCKASGYTFTNYDINWVNQRPGQGLEWIGWIYPGDGSTKYNEKFKAKATLTADKSSSTAYLQLNNLTSENSAVYFCASGYEDAMDYWGQGTSVTVSSGGGGSGGGGSGGGGSDIKMTQSPSSMYASLGERVIINCKASQDINSYLSWFQQKPGKSPKTLIYRANRLVDGVPSRFSGSGSGQDYSLTISSLEYEDMGIYYCLQYDEFPLTFGAGTKLELKRGLAVSTISSFFPPGYQIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1950 - protein, 460 aa, Artificial Sequence
  source: /note="Description of Artificial Sequence: Synthetic Chimeric Antigen Receptor sequence"
MALPVTALLLPLALLLHAARPEVQLQQSGPELVKPGASVKISCKASGYTFTDYNMHWVKQSHGKSLEWIGYIYPYNGGTGYNQKFKSKATLTVDNSSSTAYMDVRSLTSEDSAVYYCARGRPAMDYWGQGTSVTVSSGGGGSGGGGSGGGGSDIVLTQSPASLAVSLGQRATISCRASESVDNYGISFMNWFQQKPGQPPKLLIYAASNQGSGVPARFSGSGSGTDFSLNIHPMEEDDTAMYFCQQSKEVPWTFGGGTKLEIKGLAVSTISSFFPPGYQIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1951 - protein, 461 aa, Artificial Sequence
  source: /note="Description of Artificial Sequence: Synthetic Chimeric Antigen Receptor sequence"
MALPVTALLLPLALLLHAARPQVQLQQPGAEVVKPGASVKMSCKASGYTFTSYYIHWIKQTPGQGLEWVGVIYPGNDDISYNQKFKGKATLTADKSSTTAYMQLSSLTSEDSAVYYCAREVRLRYFDVWGAGTTVTVSSGGGGSGGGGSGGGGSNIMLTQSPSSLAVSAGEKVTMSCKSSQSVFFSSSQKNYLAWYQQIPGQSPKLLIYWASTRESGVPDRFTGSGSGTDFTLTISSVQSEDLAIYYCHQYLSSRTFGGGTKLEIKRGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1952 - protein, 462 aa, Artificial Sequence
  source: /note="Description of Artificial Sequence: Synthetic Chimeric Antigen Receptor sequence"
MALPVTALLLPLALLLHAARPQAYLQQSGAELVRSGASVKMSCKASGYTFTSYNLHWVKQTPGQGLEWIGYIYPGNGGTNYNQKFKGKATLTADTSSSTAYMQISSLTSEDSAVYFCARGGIYYYGSSLDYWGQGTTLTVSSGGGGSGGGGSGGGGSNIVLTQSPASLAVSLGQRATISCRASESVDNYGTTFMYWYQQKPGQPPKLLIYLASNLESGVPARFSGSGSGTDFTLTIDPVEADDAATYYCQQNKEDPWTFGGGTKLEIKGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1953 - protein, 464 aa, Artificial Sequence
  source: /note="Description of Artificial Sequence: Synthetic Chimeric Antigen Receptor sequence"
MALPVTALLLPLALLLHAARPQVQLQQPGAEVVKPGASVKMSCKASGYTFTSYYIHWIKQTPGQGLEWVGVIYPGNDDISYNQKFKGKATLTADKSSTTAYMQLSSLTSEDSAVYYCAREVRLRYFDVWGAGTTVTVSSGGGGSGGGGSGGGGSNIMLTQSPSSLAVSAGEKVTMSCKSSQSVFFSSSQKNYLAWYQQIPGQSPKLLIYWASTRESGVPDRFTGSGSGTDFTLTISSVQSEDLAIYYCHQYLSSRTFGGGTKLEIKRGLAVSTISSFFPPGYQIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1954 - protein, 465 aa, Artificial Sequence
  source: /note="Description of Artificial Sequence: Synthetic Chimeric Antigen Receptor sequence"
MALPVTALLLPLALLLHAARPEVKLQESGPELVKPGASVKMSCKASGYKFTDYVVHWLKQKPGQGLEWIGYINPYNDGTKYNEKFKGKATLTSDKSSSTAYMEVSSLTSEDSAVYYCARDYRYEVYGMDYWGQGTSVTVSSGGGGSGGGGSGGGGSDIVLTQSPTIMSASPGERVTMTCTASSSVNYIHWYQQKSGDSPLRWIFDTSKVASGVPARFSGSGSGTSYSLTISTMEAEDAATYYCQQWRSYPLTFGDGTRLELKRADAAPTVSGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1955 - protein, 468 aa, Artificial Sequence
  source: /note="Description of Artificial Sequence: Synthetic Chimeric Antigen Receptor sequence"
MALPVTALLLPLALLLHAARPEVKLQESGPELVKPGASVKMSCKASGYKFTDYVVHWLKQKPGQGLEWIGYINPYNDGTKYNEKFKGKATLTSDKSSSTAYMEVSSLTSEDSAVYYCARDYRYEVYGMDYWGQGTSVTVSSGGGGSGGGGSGGGGSDIVLTQSPTIMSASPGERVTMTCTASSSVNYIHWYQQKSGDSPLRWIFDTSKVASGVPARFSGSGSGTSYSLTISTMEAEDAATYYCQQWRSYPLTFGDGTRLELKRADAAPTVSGLAVSTISSFFPPGYQIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1956 - protein, 484 aa, Artificial Sequence
  source: /note="Description of Artificial Sequence: Synthetic Chimeric Antigen Receptor sequence"
MALPVTALLLPLALLLHAARPQVQLQQSGPELVRPGTFVKISCKASGYTFTNYDINWVNQRPGQGLEWIGWIYPGDGSTKYNEKFKAKATLTADKSSSTAYLQLNNLTSENSAVYFCASGYEDAMDYWGQGTSVTVSSGGGGSGGGGSGGGGSDIKMTQSPSSMYASLGERVIINCKASQDINSYLSWFQQKPGKSPKTLIYRANRLVDGVPSRFSGSGSGQDYSLTISSLEYEDMGIYYCLQYDEFPLTFGAGTKLELKRTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1957 - protein, 484 aa, Artificial Sequence
  source: /note="Description of Artificial Sequence: Synthetic Chimeric Antigen Receptor sequence"
MALPVTALLLPLALLLHAARPQVQLVQSGGDLAQPGRSLRLSCAASGFTFDDYAMHWVRQAPGKGLEWVAVIWPDGGQKYYGDSVKGRFTVSRDNPKNTLYLQMNSLRAEDTAIYYCVRHFNAWDYWGQGTLVTVSSASGGGGSGGGGSGGGGSDIQLTQSPSSLSAYVGGRVTITCQASQGISQFLNWFQQKPGKAPKLLISDASNLEPGVPSRFSGSGSGTDFTFTITNLQPEDIATYYCQQYDDLPLTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1958 - protein, 486 aa, Artificial Sequence
  source: /note="Description of Artificial Sequence: Synthetic Chimeric Antigen Receptor sequence"
MALPVTALLLPLALLLHAARPEVQLQQSGPELVKPGASVKISCKASGYTFTDYNMHWVKQSHGKSLEWIGYIYPYNGGTGYNQKFKSKATLTVDNSSSTAYMDVRSLTSEDSAVYYCARGRPAMDYWGQGTSVTVSSGGGGSGGGGSGGGGSDIVLTQSPASLAVSLGQRATISCRASESVDNYGISFMNWFQQKPGQPPKLLIYAASNQGSGVPARFSGSGSGTDFSLNIHPMEEDDTAMYFCQQSKEVPWTFGGGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1959 - protein, 487 aa, Artificial Sequence
  source: /note="Description of Artificial Sequence: Synthetic Chimeric Antigen Receptor sequence"
MALPVTALLLPLALLLHAARPQVQLQQSGPELVRPGTFVKISCKASGYTFTNYDINWVNQRPGQGLEWIGWIYPGDGSTKYNEKFKAKATLTADKSSSTAYLQLNNLTSENSAVYFCASGYEDAMDYWGQGTSVTVSSGGGGSGGGGSGGGGSDIKMTQSPSSMYASLGERVIINCKASQDINSYLSWFQQKPGKSPKTLIYRANRLVDGVPSRFSGSGSGQDYSLTISSLEYEDMGIYYCLQYDEFPLTFGAGTKLELKRTTTPAPRPPTPAPTIASQPLSLRPEACRPAAGGAVHTRGLDFACDIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1960 - protein, 488 aa, Artificial Sequence
  source: /note="Description of Artificial Sequence: Synthetic Chimeric Antigen Receptor sequence"
MALPVTALLLPLALLLHAARPQVQLVQSGAEVKKPGESLKISCKGSGYSFTNYWIGWVRQMPGKGLEWMGIIYPGDSDTRYSPSFQGQVTISADKSISTAYLQWSSLKASDTAMYYCARHGPSSWGEFDYWGQGTLVTVSSASGGGGSGGGGSGGGGSDIRLTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVDIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1961 - protein, 489 aa, Artificial Sequence
  source: /note="Description of Artificial Sequence: Synthetic Chimeric Antigen Receptor sequence"
MALPVTALLLPLALLLHAARPEVQLQQSGPELVKPGASVKISCKASGYTFTDYNMHWVKQSHGKSLEWIGYIYPYNGGTGYNQKFKSKATLTVDNSSSTAYMDVRSLTSEDSAVYYCARGRPAMDYWGQGTSVTVSSGGGGSGGGGSGGGGSDIVLTQSPASLAVSLGQRATISCRASESVDNYGISFMNWFQQKPGQPPKLLIYAASNQGSGVPARFSGSGSGTDFSLNIHPMEEDDTAMYFCQQSKEVPWTFGGGTKLEIKTTTPAPRPPTPAPTIASQPLSLRPEACRPAAGGAVHTRGLDFACDIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1962 - protein, 489 aa, Artificial Sequence
  source: /note="Description of Artificial Sequence: Synthetic Chimeric Antigen Receptor sequence"
MALPVTALLLPLALLLHAARPEVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCAKETDYYGSGTFDYWGQGTLVTVSSASGGGGSGGGGSGGGGSDIQMTQSPSSLSASVGDRVTISCRASQGIGIYLAWYQQRSGKPPQLLIHGASTLQSGVPSRFSGSGSGTDFTLTISSLQPEDFASYWCQQSNNFPPTFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1963 - protein, 489 aa, Artificial Sequence
  source: /note="Description of Artificial Sequence: Synthetic Chimeric Antigen Receptor sequence"
MALPVTALLLPLALLLHAARPQVQLVQSGAEVKKPGASVRVSCKASGYMFTDFFIHWVRQAPGQGLEWMGWINPNSGVTKYAQKFQGRVTMTRNTSISTAYMELSSLRSEDTAVYYCATWYSSGWYGIANIWGQGTMVTVSSASGGGGSGGGGSGGGGSDIQLTQSPSSLSASVGDRVTITCQASHDISNYLHWYQQKPGKAPKLLIYDASNLETGVPSRFTGSGSGTDFTLTIRSLQPEDVAAYYCQQSDDLPHTFGQGTKVDIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1964 - protein, 490 aa, Artificial Sequence
  source: /note="Description of Artificial Sequence: Synthetic Chimeric Antigen Receptor sequence"
MALPVTALLLPLALLLHAARPQVQLQQPGAEVVKPGASVKMSCKASGYTFTSYYIHWIKQTPGQGLEWVGVIYPGNDDISYNQKFKGKATLTADKSSTTAYMQLSSLTSEDSAVYYCAREVRLRYFDVWGAGTTVTVSSGGGGSGGGGSGGGGSNIMLTQSPSSLAVSAGEKVTMSCKSSQSVFFSSSQKNYLAWYQQIPGQSPKLLIYWASTRESGVPDRFTGSGSGTDFTLTISSVQSEDLAIYYCHQYLSSRTFGGGTKLEIKRTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1965 - protein, 492 aa, Artificial Sequence
  source: /note="Description of Artificial Sequence: Synthetic Chimeric Antigen Receptor sequence"
MALPVTALLLPLALLLHAARPQVQLVQSGGGVVQPGKSLRLSCAASGFTFSIFAMHWVRQAPGKGLEWVATISYDGSNAFYADSVEGRFTISRDNSKDSLYLQMDSLRPEDTAVYYCVKAGDGGYDVFDSWGQGTLVTVSSASGGGGSGGGGSGGGGSEIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPTFGPGTKVDIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1966 - protein, 493 aa, Artificial Sequence
  source: /note="Description of Artificial Sequence: Synthetic Chimeric Antigen Receptor sequence"
MALPVTALLLPLALLLHAARPQVQLQQPGAEVVKPGASVKMSCKASGYTFTSYYIHWIKQTPGQGLEWVGVIYPGNDDISYNQKFKGKATLTADKSSTTAYMQLSSLTSEDSAVYYCAREVRLRYFDVWGAGTTVTVSSGGGGSGGGGSGGGGSNIMLTQSPSSLAVSAGEKVTMSCKSSQSVFFSSSQKNYLAWYQQIPGQSPKLLIYWASTRESGVPDRFTGSGSGTDFTLTISSVQSEDLAIYYCHQYLSSRTFGGGTKLEIKRTTTPAPRPPTPAPTIASQPLSLRPEACRPAAGGAVHTRGLDFACDIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1967 - protein, 493 aa, Artificial Sequence
  source: /note="Description of Artificial Sequence: Synthetic Chimeric Antigen Receptor sequence"
MALPVTALLLPLALLLHAARPQVQLVQSGGGLVQPGGSLRLSCAASGFTFSSYAMSWVRQAPGKGLEWVSAISGSGGSTYYADSVKGRFTISRDNSKNTLYLQMNSLRAEDTAVYYCAKEDTIRGPNYYYYGMDVWGQGTTVTVSSASGGGGSGGGGSGGGGSETTLTQSPSSVSASVGDRVSITCRASQDIDTWLAWYQLKPGKAPKLLMYAASNLQGGVPSRFSGSGSGTDFILTISSLQPEDFATYYCQQASIFPPTFGGGTKVDIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1968 - protein, 494 aa, Artificial Sequence
  source: /note="Description of Artificial Sequence: Synthetic Chimeric Antigen Receptor sequence"
MALPVTALLLPLALLLHAARPEVKLQESGPELVKPGASVKMSCKASGYKFTDYVVHWLKQKPGQGLEWIGYINPYNDGTKYNEKFKGKATLTSDKSSSTAYMEVSSLTSEDSAVYYCARDYRYEVYGMDYWGQGTSVTVSSGGGGSGGGGSGGGGSDIVLTQSPTIMSASPGERVTMTCTASSSVNYIHWYQQKSGDSPLRWIFDTSKVASGVPARFSGSGSGTSYSLTISTMEAEDAATYYCQQWRSYPLTFGDGTRLELKRADAAPTVSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1969 - protein, 494 aa, Artificial Sequence
  source: /note="Description of Artificial Sequence: Synthetic Chimeric Antigen Receptor sequence"
MALPVTALLLPLALLLHAARPQVQLVQSGAEVKKPGESLKISCKGSGYSFTSYWIGWVRQMPGKGLEWMGIIYPGDSDTRYSPSFQGQVTISADKSITTAYLQWSSLRASDSAMYYCARGGYSDYDYYFDFWGQGTLVTVSSASGGGGSGGGGSGGGGSEIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPFTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1970 - protein, 495 aa, Artificial Sequence
  source: /note="Description of Artificial Sequence: Synthetic Chimeric Antigen Receptor sequence"
MALPVTALLLPLALLLHAARPQVQLVQSGAEVKKPGASVRVSCKASGYIFTNYYVHWVRQAPGQGLEWMGIISPSGGSPTYAQRLQGRVTMTRDLSTSTVYMELSSLTSEDTAVYFCARESRLRGNRLGLQSSIFDHWGQGTLVTVSSASGGGGSGGGGSGGGGSDIRMTQSPPSLSASVGDRVTIPCQASQDINNHLNWYQQKPGKAPQLLIYDTSNLEIGVPSRFSGSGSGTDFTLTISSLQPEDIATYYCQQYENLPLTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1971 - protein, 497 aa, Artificial Sequence
  source: /note="Description of Artificial Sequence: Synthetic Chimeric Antigen Receptor sequence"
MALPVTALLLPLALLLHAARPEVKLQESGPELVKPGASVKMSCKASGYKFTDYVVHWLKQKPGQGLEWIGYINPYNDGTKYNEKFKGKATLTSDKSSSTAYMEVSSLTSEDSAVYYCARDYRYEVYGMDYWGQGTSVTVSSGGGGSGGGGSGGGGSDIVLTQSPTIMSASPGERVTMTCTASSSVNYIHWYQQKSGDSPLRWIFDTSKVASGVPARFSGSGSGTSYSLTISTMEAEDAATYYCQQWRSYPLTFGDGTRLELKRADAAPTVSTTTPAPRPPTPAPTIASQPLSLRPEACRPAAGGAVHTRGLDFACDIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1972 - protein, 652 aa, Artificial Sequence
  source: /note="Description of Artificial Sequence: Synthetic Chimeric Antigen Receptor sequence"
QVQLQQSGPELVRPGTFVKISCKASGYTFTNYDINWVNQRPGQGLEWIGWIYPGDGSTKYNEKFKAKATLTADKSSSTAYLQLNNLTSENSAVYFCASGYEDAMDYWGQGTSVTVSSGGGGSGGGGSGGGGSDIKMTQSPSSMYASLGERVIINCKASQDINSYLSWFQQKPGKSPKTLIYRANRLVDGVPSRFSGSGSGQDYSLTISSLEYEDMGIYYCLQYDEFPLTFGAGTKLELKREPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1973 - protein, 670 aa, Artificial Sequence
  source: /note="Description of Artificial Sequence: Synthetic Chimeric Antigen Receptor sequence"
MALPVTALLLPLALLLHAARPQVQLQQSGPELVRPGTFVKISCKASGYTFTNYDINWVNQRPGQGLEWIGWIYPGDGSTKYNEKFKAKATLTADKSSSTAYLQLNNLTSENSAVYFCASGYEDAMDYWGQGTSVTVSSGGGGSGGGGSGGGGSDIKMTQSPSSMYASLGERVIINCKASQDINSYLSWFQQKPGKSPKTLIYRANRLVDGVPSRFSGSGSGQDYSLTISSLEYEDMGIYYCLQYDEFPLTFGAGTKLELKREPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1974 - protein, 672 aa, Artificial Sequence
  source: /note="Description of Artificial Sequence: Synthetic Chimeric Antigen Receptor sequence"
MALPVTALLLPLALLLHAARPEVQLQQSGPELVKPGASVKISCKASGYTFTDYNMHWVKQSHGKSLEWIGYIYPYNGGTGYNQKFKSKATLTVDNSSSTAYMDVRSLTSEDSAVYYCARGRPAMDYWGQGTSVTVSSGGGGSGGGGSGGGGSDIVLTQSPASLAVSLGQRATISCRASESVDNYGISFMNWFQQKPGQPPKLLIYAASNQGSGVPARFSGSGSGTDFSLNIHPMEEDDTAMYFCQQSKEVPWTFGGGTKLEIKEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1975 - protein, 673 aa, Artificial Sequence
  source: /note="Description of Artificial Sequence: Synthetic Chimeric Antigen Receptor sequence"
MALPVTALLLPLALLLHAARPQVQLQQSGPELVRPGTFVKISCKASGYTFTNYDINWVNQRPGQGLEWIGWIYPGDGSTKYNEKFKAKATLTADKSSSTAYLQLNNLTSENSAVYFCASGYEDAMDYWGQGTSVTVSSGGGGSGGGGSGGGGSDIKMTQSPSSMYASLGERVIINCKASQDINSYLSWFQQKPGKSPKTLIYRANRLVDGVPSRFSGSGSGQDYSLTISSLEYEDMGIYYCLQYDEFPLTFGAGTKLELKREPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1976 - protein, 675 aa, Artificial Sequence
  source: /note="Description of Artificial Sequence: Synthetic Chimeric Antigen Receptor sequence"
MALPVTALLLPLALLLHAARPEVQLQQSGPELVKPGASVKISCKASGYTFTDYNMHWVKQSHGKSLEWIGYIYPYNGGTGYNQKFKSKATLTVDNSSSTAYMDVRSLTSEDSAVYYCARGRPAMDYWGQGTSVTVSSGGGGSGGGGSGGGGSDIVLTQSPASLAVSLGQRATISCRASESVDNYGISFMNWFQQKPGQPPKLLIYAASNQGSGVPARFSGSGSGTDFSLNIHPMEEDDTAMYFCQQSKEVPWTFGGGTKLEIKEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1977 - protein, 676 aa, Artificial Sequence
  source: /note="Description of Artificial Sequence: Synthetic Chimeric Antigen Receptor sequence"
MALPVTALLLPLALLLHAARPQVQLQQPGAEVVKPGASVKMSCKASGYTFTSYYIHWIKQTPGQGLEWVGVIYPGNDDISYNQKFKGKATLTADKSSTTAYMQLSSLTSEDSAVYYCAREVRLRYFDVWGAGTTVTVSSGGGGSGGGGSGGGGSNIMLTQSPSSLAVSAGEKVTMSCKSSQSVFFSSSQKNYLAWYQQIPGQSPKLLIYWASTRESGVPDRFTGSGSGTDFTLTISSVQSEDLAIYYCHQYLSSRTFGGGTKLEIKREPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1978 - protein, 679 aa, Artificial Sequence
  source: /note="Description of Artificial Sequence: Synthetic Chimeric Antigen Receptor sequence"
MALPVTALLLPLALLLHAARPQVQLQQPGAEVVKPGASVKMSCKASGYTFTSYYIHWIKQTPGQGLEWVGVIYPGNDDISYNQKFKGKATLTADKSSTTAYMQLSSLTSEDSAVYYCAREVRLRYFDVWGAGTTVTVSSGGGGSGGGGSGGGGSNIMLTQSPSSLAVSAGEKVTMSCKSSQSVFFSSSQKNYLAWYQQIPGQSPKLLIYWASTRESGVPDRFTGSGSGTDFTLTISSVQSEDLAIYYCHQYLSSRTFGGGTKLEIKREPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1979 - protein, 680 aa, Artificial Sequence
  source: /note="Description of Artificial Sequence: Synthetic Chimeric Antigen Receptor sequence"
MALPVTALLLPLALLLHAARPEVKLQESGPELVKPGASVKMSCKASGYKFTDYVVHWLKQKPGQGLEWIGYINPYNDGTKYNEKFKGKATLTSDKSSSTAYMEVSSLTSEDSAVYYCARDYRYEVYGMDYWGQGTSVTVSSGGGGSGGGGSGGGGSDIVLTQSPTIMSASPGERVTMTCTASSSVNYIHWYQQKSGDSPLRWIFDTSKVASGVPARFSGSGSGTSYSLTISTMEAEDAATYYCQQWRSYPLTFGDGTRLELKRADAAPTVSEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1980 - protein, 683 aa, Artificial Sequence
  source: /note="Description of Artificial Sequence: Synthetic Chimeric Antigen Receptor sequence"
MALPVTALLLPLALLLHAARPEVKLQESGPELVKPGASVKMSCKASGYKFTDYVVHWLKQKPGQGLEWIGYINPYNDGTKYNEKFKGKATLTSDKSSSTAYMEVSSLTSEDSAVYYCARDYRYEVYGMDYWGQGTSVTVSSGGGGSGGGGSGGGGSDIVLTQSPTIMSASPGERVTMTCTASSSVNYIHWYQQKSGDSPLRWIFDTSKVASGVPARFSGSGSGTSYSLTISTMEAEDAATYYCQQWRSYPLTFGDGTRLELKRADAAPTVSEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1981 - protein, 464 aa, Artificial Sequence
  source: /note="Description of Artificial Sequence: Synthetic Chimeric Antigen Receptor sequence"
MALPVTALLLPLALLLHAARPQIQLVQSGPELKKPGETVKISCKASGYTFTKYGMNWVKQTPGKGLKWMGWINTNSGEPTYAEEFKGRFAFSLETSASTAYLQINNLKNEDTATYFCARGAYYRYDGEVSYYAMDYWGQGTSVTVSSGGGGSGGGGSGGGGSQIILTQSPAIMSASLGERVTMTCTATSSLSSSYLHWYQQKPGSSPKLWIYSTSHLASGVPARFSGGGSGTSYSLTISSMEAEDAATYYCHQYHLSPYTFGGGTKLEIKGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1982 - protein, 471 aa, Artificial Sequence
  source: /note="Description of Artificial Sequence: Synthetic Chimeric Antigen Receptor sequence"
PLALLLHAARPEVQLLESGGGLVQPGGSLRLSCAVSGFTFNSFAMSWVRQAPGKGLEWVSAISGSGGGTYYADSVKGRFTISRDNSKNTLYLQMNSLRAEDTAVYFCAKDKILWFGEPVFDYWGQGTLVTVSSASGGGGSGGGGSGGGGSEIVLTQSPATLSLSPGERATLSCRASQSVSSYLAWYQQKPGQAPRLLIYDASNRATGIPARFSGSGSGTDFTLTISSLEPEDFAVYYCQQRSNWPPTFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDA

SEQ ID NO: 1983 - protein, 472 aa, Artificial Sequence
  source: /note="Description of Artificial Sequence: Synthetic Chimeric Antigen Receptor sequence"
MALPVTALLLPLALLLHAARPPLALLLHAARPEVQLQQSGAELVRPGASVKLSCTASGFNIKDSLIHWVKQRPEQGLEWIGWIDPEDDKTKYAPKFQDKATLTADTSSNTAYLQLSTLTSEDTAIYYCVSRYINYYFAYWGQGTTLTVSSGGGGSGGGGSGGGGSDIVMTQSPSSLTVTAGEKVTMSCKSSQSLLHSGNQRNYLTWYQQKPGQPPKLLIYWASTRESGVPDRFTGSGSGTDFTLTISSVQAEDLAVYYCQNDYDYPYTFGGGTKLEIKGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1984 - protein, 488 aa, Artificial Sequence
  source: /note="Description of Artificial Sequence: Synthetic Chimeric Antigen Receptor sequence"
MALPVTALLLPLALLLHAARPQIQLVQSGPEVKKPGETVKISCKASGYTFTNYGMNWVKQAPGKGLKWMGINTYTGEPTYADAFKGRFAFSLETSASTAYLQINNLKNEDTATYFCARDYGDYGMDYWGQGTSVTVSSGGGGSGGGGSGGGGSDIVLTQSPASLAVSLGQRATISCRASKSVSTSGYSFMHWYQQKPGQPPKLLIYLASNLESGVPARFSGSGSGTDFTLNIHPVEEEDAATYYCQHSREVPWTFGGGTKLEIKRTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1985 - protein, 490 aa, Artificial Sequence
  source: /note="Description of Artificial Sequence: Synthetic Chimeric Antigen Receptor sequence"
MALPVTALLLPLALLLHAARPEVQLQQSGAELVRPGASVKLSCTASGFNIKDSLIHWVKQRPEQGLEWIGWIDPEDDKTKYAPKFQDKATLTADTSSNTAYLQLSTLTSEDTAIYYCVSRYINYYFAYWGQGTTLTVSSGGGGSGGGGSGGGGSDIVMTQSPSSLTVTAGEKVTMSCKSSQSLLHSGNQRNYLTWYQQKPGQPPKLLIYWASTRESGVPDRFTGSGSGTDFTLTISSVQAEDLAVYYCQNDYDYPYTFGGGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1986 - protein, 491 aa, Artificial Sequence
  source: /note="Description of Artificial Sequence: Synthetic Chimeric Antigen Receptor sequence"
MALPVTALLLPLALLLHAARPQAYLQQSGAELVRSGASVKMSCKASGYTFTSYNLHWVKQTPGQGLEWIGYIYPGNGGTNYNQKFKGKATLTADTSSSTAYMQISSLTSEDSAVYFCARGGIYYYGSSLDYWGQGTTLTVSSGGGGSGGGGSGGGGSNIVLTQSPASLAVSLGQRATISCRASESVDNYGTTFMYWYQQKPGQPPKLLIYLASNLESGVPARFSGSGSGTDFTLTIDPVEADDAATYYCQQNKEDPWTFGGGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1987 - protein, 493 aa, Artificial Sequence
  source: /note="Description of Artificial Sequence: Synthetic Chimeric Antigen Receptor sequence"
MALPVTALLLPLALLLHAARPQIQLVQSGPELKKPGETVKISCKASGYTFTKYGMNWVKQTPGKGLKWMGWINTNSGEPTYAEEFKGRFAFSLETSASTAYLQINNLKNEDTATYFCARGAYYRYDGEVSYYAMDYWGQGTSVTVSSGGGGSGGGGSGGGGSQIILTQSPAIMSASLGERVTMTCTATSSLSSSYLHWYQQKPGSSPKLWIYSTSHLASGVPARFSGGGSGTSYSLTISSMEAEDAATYYCHQYHLSPYTFGGGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1988 - protein, 535 aa, Artificial Sequence
  source: /note="Description of Artificial Sequence: Synthetic Chimeric Antigen Receptor sequence"
MALPVTALLLPLALLLHAARPDIVMTQSPDSLAVSLGERVTMNCKSSQSLLYSTNQKNYLAWYQQKPGQSPKLLIYWASTRESGVPDRFSGSGSGTDFTLTISSVQAEDVAVYYCQQYYSYRTFGGGTKLEIKGGGGSGGGGSGGGGSQVQLQQSGPEVVKPGASVKMSCKASGYTFTSYVIHWVRQKPGQGLDWIGYINPYNDGTDYDEKFKGKATLTSDTSTSTAYMELSSLRSEDTAVYYCAREKDNYATGAWFAYWGQGTLVTVSSTTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSKRGRKKLLYIFKQPFMRPVQTTQEEDGCSCRFPEEEEGGCELRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPR

SEQ ID NO: 1989 - protein, 657 aa, Artificial Sequence [sequence omitted]

SEQ ID NO: 1990 - protein, 676 aa, Artificial Sequence
  source: /note="Description of Artificial Sequence: Synthetic Chimeric Antigen Receptor sequence"
MALPVTALLLPLALLLHAARPEVQLQQSGAELVRPGASVKLSCTASGFNIKDSLIHWVKQRPEQGLEWIGWIDPEDDKTKYAPKFQDKATLTADTSSNTAYLQLSTLTSEDTAIYYCVSRYINYYFAYWGQGTTLTVSSGGGGSGGGGSGGGGSDIVMTQSPSSLTVTAGEKVTMSCKSSQSLLHSGNQRNYLTWYQQKPGQPPKLLIYWASTRESGVPDRFTGSGSGTDFTLTISSVQAEDLAVYYCQNDYDYPYTFGGGTKLEIKEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1991 - protein, 677 aa, Artificial Sequence
  source: /note="Description of Artificial Sequence: Synthetic Chimeric Antigen Receptor sequence"
MALPVTALLLPLALLLHAARPQAYLQQSGAELVRSGASVKMSCKASGYTFTSYNLHWVKQTPGQGLEWIGYIYPGNGGTNYNQKFKGKATLTADTSSSTAYMQISSLTSEDSAVYFCARGGIYYYGSSLDYWGQGTTLTVSSGGGGSGGGGSGGGGSNIVLTQSPASLAVSLGQRATISCRASESVDNYGTTFMYWYQQKPGQPPKLLIYLASNLESGVPARFSGSGSGTDFTLTIDPVEADDAATYYCQQNKEDPWTFGGGTKLEIKEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1992 - protein, 679 aa, Artificial Sequence
  source: /note="Description of Artificial Sequence: Synthetic Chimeric Antigen Receptor sequence"
MALPVTALLLPLALLLHAARPQIQLVQSGPELKKPGETVKISCKASGYTFTKYGMNWVKQTPGKGLKWMGWINTNSGEPTYAEEFKGRFAFSLETSASTAYLQINNLKNEDTATYFCARGAYYRYDGEVSYYAMDYWGQGTSVTVSSGGGGSGGGGSGGGGSQIILTQSPAIMSASLGERVTMTCTATSSLSSSYLHWYQQKPGSSPKLWIYSTSHLASGVPARFSGGGSGTSYSLTISSMEAEDAATYYCHQYHLSPYTFGGGTKLEIKEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1993 - protein, 536 aa, Artificial Sequence
  source: /note="Description of Artificial Sequence: Synthetic Chimeric Antigen Receptor sequence"
MALPVTALLLPLALLLHAARPDIVMTQSPDSLAVSLGERATINCRASKSVSTSGYSYIYWYQQKPGQPPKLLIYLASILESGVPDRFSGSGSGTDFTLTISSLQAEDVAVYYCQHSRELPWTFGQGTKVEIKGGGGSGGGGSGGGGSEEQLVESGGGLVKPGGSLRLSCAASGFSFSDCRMYWLRQAPGKGLEWIGVISVKSENYGANYAESVRGRFTISRDDSKNTVYLQMNSLKTEDTAVYYCSASYYRYDVGAWFAYWGQGTLVTVSSTTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSKRGRKKLLYIFKQPFMRPVQTTQEEDGCSCRFPEEEEGGCELRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPR

SEQ ID NO: 1994 - protein, 692 aa, Artificial Sequence
  source: /note="Description of Artificial Sequence: Synthetic Chimeric Antigen Receptor sequence"
MVRGVPFRHLLLVLQLALLPAATQGKKVVLGKKGDTVELTCTASQKKSIQFHWKNSNQIKILGNQGSFLTKGPSKLNDRADSRRSLWDQGNFPLIIKNLKIEDSDTYICEVEDQKEEVQLLVFGLTANSDTHLLQGQSLTLTLESPPGSSPSVQCRSPRGKNIQGGKTLSVSQLELQDSGTWTCTVLQNQKKVEFKIDIVVLAFQKASGGGGSGGGGSQVQLLESGAEVKKPGSSVKVSCKASGDTFIRYSFTWVRQAPGQGLEWMGRIITILDVAHYAPHLQGRVTITADKSTSTVYLELRNLRSDDTAVYFCAGVYEGEADEGEYDNNGFLKHWGQGTLVTVTSGGGGSGGGGSGGGGSELELTQSPATLSVSPGERATLSCRASESVSSDLAWYQQKPGQAPRLLIYGASTRATGVPARFSGSGSGAEFTLTISSLQSEDFAVYYCQQYNNWPPRYTFGQGTRLEIKAAAIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1995 - protein, 717 aa, Artificial Sequence [sequence omitted]

SEQ ID NO: 1996 - protein, 669 aa, Artificial Sequence
  source: /note="Description of Artificial Sequence: Synthetic Chimeric Antigen Receptor sequence"
MEAPAQLLFLLLLWLPDTTGEIVLTQSPATLSLSPGERATLSCSASSSINYIYWLQQKPGQAPRILIYLTSNLASGVPARFSGSGSGTDFTLTISSLEPEDFAVYYCLQWSSNPLTFGGGTKVEIKRGGGGSGGGGSGGGGSGGGGSEVQLVESGGGLVKPGGSLRLSCAASGFTFSSYDMSWVRQAPGKGLEWVSTISSGGSYTYYLDSIKGRFTISRDNAKNSLYLQMNSLRAEDTAVYYCARQGLDYWGRGTLVTVSSGDPKEACPTGLYTHSGECCKACNLGEGVAQPCGANQTVCEPCLDSVTFSDVVSATEPCKPCTECVGLQSMSAPCVEADDAVCRCAYGYYQDETTGRCEACRVCEAGSGLVFSCQDKQNTVCEECPDGTYSDEANHVDPCLPCTVCEDTERQLRECTRWADAECEEIPGRWITRSTPPEGSDSTAPSTQEPEAPPEQDLIASTVAGVVTTVMGSSQPVVTRGTTDNPKFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPR

SEQ ID NO: 1997 - protein, 251 aa, Artificial Sequence
  source: /note="Description of Artificial Sequence: Synthetic Chimeric Antigen Receptor sequence"
MEAPAQLLFLLLLWLPDTTGEIVLTQSPATLSLSPGERATLSCSASSSINYIYWLQQKPGQAPRILIYLTSNLASGVPARFSGSGSGTDFTLTISSLEPEDFAVYYCLQWSSNPLTFGGGTKVEIKRGGGGSGGGGSEVQLVESGGGLVKPGGSLRLSCAASGFTFSSYDMSWVRQAPGKGLEWVSTISSGGSYTYYLDSIKGRFTISRDNAKNSLYLQMNSLRAEDTAVYYCARQGLDYWGRGTLVTVSS

SEQ ID NO: 1998 - protein, 576 aa, Artificial Sequence
  source: /note="Description of Artificial Sequence: Synthetic Chimeric Antigen Receptor sequence"
MEAPAQLLFLLLLWLPDTTGEIVLTQSPATLSLSPGERATLSCSASSSINYIYWLQQKPGQAPRILIYLTSNLASGVPARFSGSGSGTDFTLTISSLEPEDFAVYYCLQWSSNPLTFGGGTKVEIKRGGGGSGGGGSEVQLVESGGGLVKPGGSLRLSCAASGFTFSSYDMSWVRQAPGKGLEWVSTISSGGSYTYYLDSIKGRFTISRDNAKNSLYLQMNSLRAEDTAVYYCARQGLDYWGRGTLVTVSSGDPKEACPTGLYTHSGECCKACNLGEGVAQPCGANQTVCEPCLDSVTFSDVVSATEPCKPCTECVGLQSMSAPCVEADDAVCRCAYGYYQDETTGRCEACRVCEAGSGLVFSCQDKQNTVCEECPDGTYSDEAARAADAECEEPKFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1999 - protein, 586 aa, Artificial Sequence
  source: /note="Description of Artificial Sequence: Synthetic Chimeric Antigen Receptor sequence"
MEAPAQLLFLLLLWLPDTTGEIVLTQSPATLSLSPGERATLSCSASSSINYIYWLQQKPGQAPRILIYLTSNLASGVPARFSGSGSGTDFTLTISSLEPEDFAVYYCLQWSSNPLTFGGGTKVEIKRGGGGSGGGGSGGGGSGGGGSEVQLVESGGGLVKPGGSLRLSCAASGFTFSSYDMSWVRQAPGKGLEWVSTISSGGSYTYYLDSIKGRFTISRDNAKNSLYLQMNSLRAEDTAVYYCARQGLDYWGRGTLVTVSSGDPKEACPTGLYTHSGECCKACNLGEGVAQPCGANQTVCEPCLDSVTFSDVVSATEPCKPCTECVGLQSMSAPCVEADDAVCRCAYGYYQDETTGRCEACRVCEAGSGLVFSCQDKQNTVCEECPDGTYSDEAARAADAECEEPKFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2000 - protein, 587 aa, Artificial Sequence
  source: /note="Description of Artificial Sequence: Synthetic Chimeric Antigen Receptor sequence"
MEAPAQLLFLLLLWLPDTTGEIVLTQSPATLSLSPGERATLSCSASSSINYIYWLQQKPGQAPRILIYLTSNLASGVPARFSGSGSGTDFTLTISSLEPEDFAVYYCLQWSSNPLTFGGGTKVEIKRGGGGSGGGGSGGGGSGGGGSEVQLVESGGGLVKPGGSLRLSCAASGFTFSSYDMSWVRQAPGKGLEWVSTISSGGSYTYYLDSIKGRFTISRDNAKNSLYLQMNSLRAEDTAVYYCARQGLDYWGRGTLVTVSSGDPKEACPTGLYTHSGECCKACNLGEGVAQPCGANQTVCEPCLDSVTFSDVVSATEPCKPCTECVGLQSMSAPCVEADDAVCRCAYGYYQDETTGRCEACRVCEAGSGLVFSCQDKQNTVCEECPDGTYSDEAARAADAECEEPKFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPR

SEQ ID NO: 2001 - protein, 598 aa, Artificial Sequence
  source: /note="Description of Artificial Sequence: Synthetic Chimeric Antigen Receptor sequence"
MEAPAQLLFLLLLWLPDTTGEIVLTQSPATLSLSPGERATLSCSASSSINYIYWLQQKPGQAPRILIYLTSNLASGVPARFSGSGSGTDFTLTISSLEPEDFAVYYCLQWSSNPLTFGGGTKVEIKRGGGGSGGGGSEVQLVESGGGLVKPGGSLRLSCAASGFTFSSYDMSWVRQAPGKGLEWVSTISSGGSYTYYLDSIKGRFTISRDNAKNSLYLQMNSLRAEDTAVYYCARQGLDYWGRGTLVTVSSGDPKEACPTGLYTHSGECCKACNLGEGVAQPCGANQTVCEPCLDSVTFSDVVSATEPCKPCTECVGLQSMSAPCVEADDAVCRCAYGYYQDETTGRCEACRVCEAGSGLVFSCQDKQNTVCEECPDGTYSDEANHVDPCLPCTVCEDTERQLRECTRWADAECEEPKFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2002 - protein, 608 aa, Artificial Sequence
  source: /note="Description of Artificial Sequence: Synthetic Chimeric Antigen Receptor sequence"
MEAPAQLLFLLLLWLPDTTGEIVLTQSPATLSLSPGERATLSCSASSSINYIYWLQQKPGQAPRILIYLTSNLASGVPARFSGSGSGTDFTLTISSLEPEDFAVYYCLQWSSNPLTFGGGTKVEIKRGGGGSGGGGSGGGGSGGGGSEVQLVESGGGLVKPGGSLRLSCAASGFTFSSYDMSWVRQAPGKGLEWVSTISSGGSYTYYLDSIKGRFTISRDNAKNSLYLQMNSLRAEDTAVYYCARQGLDYWGRGTLVTVSSGDPKEACPTGLYTHSGECCKACNLGEGVAQPCGANQTVCEPCLDSVTFSDVVSATEPCKPCTECVGLQSMSAPCVEADDAVCRCAYGYYQDETTGRCEACRVCEAGSGLVFSCQDKQNTVCEECPDGTYSDEANHVDPCLPCTVCEDTERQLRECTRWADAECEEPKFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2003 - protein, 609 aa, Artificial Sequence
  source: /note="Description of Artificial Sequence: Synthetic Chimeric Antigen Receptor sequence"
MEAPAQLLFLLLLWLPDTTGEIVLTQSPATLSLSPGERATLSCSASSSINYIYWLQQKPGQAPRILIYLTSNLASGVPARFSGSGSGTDFTLTISSLEPEDFAVYYCLQWSSNPLTFGGGTKVEIKRGGGGSGGGGSGGGGSGGGGSEVQLVESGGGLVKPGGSLRLSCAASGFTFSSYDMSWVRQAPGKGLEWVSTISSGGSYTYYLDSIKGRFTISRDNAKNSLYLQMNSLRAEDTAVYYCARQGLDYWGRGTLVTVSSGDPKEACPTGLYTHSGECCKACNLGEGVAQPCGANQTVCEPCLDSVTFSDVVSATEPCKPCTECVGLQSMSAPCVEADDAVCRCAYGYYQDETTGRCEACRVCEAGSGLVFSCQDKQNTVCEECPDGTYSDEANHVDPCLPCTVCEDTERQLRECTRWADAECEEPKFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPR

SEQ ID NO: 2004 - protein, 636 aa, Artificial Sequence
  source: /note="Description of Artificial Sequence: Synthetic Chimeric Antigen Receptor sequence"
MEAPAQLLFLLLLWLPDTTGEIVLTQSPATLSLSPGERATLSCSASSSINYIYWLQQKPGQAPRILIYLTSNLASGVPARFSGSGSGTDFTLTISSLEPEDFAVYYCLQWSSNPLTFGGGTKVEIKRGGGGSGGGGSEVQLVESGGGLVKPGGSLRLSCAASGFTFSSYDMSWVRQAPGKGLEWVSTISSGGSYTYYLDSIKGRFTISRDNAKNSLYLQMNSLRAEDTAVYYCARQGLDYWGRGTLVTVSSGDPKEACPTGLYTHSGECCKACNLGEGVAQPCGANQTVCEPCLDSVTFSDVVSATEPCKPCTECVGLQSMSAPCVEADDAVCRCAYGYYQDETTGRCEACRVCEAGSGLVFSCQDKQNTVCEECPDGTYSDEAARAADAECEEIPGRWITRSTPPEGSDSTAPSTQEPEAPPEQDLIASTVAGVVTTVMGSSQPVVTRGTTDNPKFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2005 - protein, 646 aa, Artificial Sequence
  source: /note="Description of Artificial Sequence: Synthetic Chimeric Antigen Receptor sequence"
MEAPAQLLFLLLLWLPDTTGEIVLTQSPATLSLSPGERATLSCSASSSINYIYWLQQKPGQAPRILIYLTSNLASGVPARFSGSGSGTDFTLTISSLEPEDFAVYYCLQWSSNPLTFGGGTKVEIKRGGGGSGGGGSGGGGSGGGGSEVQLVESGGGLVKPGGSLRLSCAASGFTFSSYDMSWVRQAPGKGLEWVSTISSGGSYTYYLDSIKGRFTISRDNAKNSLYLQMNSLRAEDTAVYYCARQGLDYWGRGTLVTVSSGDPKEACPTGLYTHSGECCKACNLGEGVAQPCGANQTVCEPCLDSVTFSDVVSATEPCKPCTECVGLQSMSAPCVEADDAVCRCAYGYYQDETTGRCEACRVCEAGSGLVFSCQDKQNTVCEECPDGTYSDEAARAADAECEEIPGRWITRSTPPEGSDSTAPSTQEPEAPPEQDLIASTVAGVVTTVMGSSQPVVTRGTTDNPKFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2006 - protein, 647 aa, Artificial Sequence
  source: /note="Description of Artificial Sequence: Synthetic Chimeric Antigen Receptor sequence"
MEAPAQLLFLLLLWLPDTTGEIVLTQSPATLSLSPGERATLSCSASSSINYIYWLQQKPGQAPRILIYLTSNLASGVPARFSGSGSGTDFTLTISSLEPEDFAVYYCLQWSSNPLTFGGGTKVEIKRGGGGSGGGGSGGGGSGGGGSEVQLVESGGGLVKPGGSLRLSCAASGFTFSSYDMSWVRQAPGKGLEWVSTISSGGSYTYYLDSIKGRFTISRDNAKNSLYLQMNSLRAEDTAVYYCARQGLDYWGRGTLVTVSSGDPKEACPTGLYTHSGECCKACNLGEGVAQPCGANQTVCEPCLDSVTFSDVVSATEPCKPCTECVGLQSMSAPCVEADDAVCRCAYGYYQDETTGRCEACRVCEAGSGLVFSCQDKQNTVCEECPDGTYSDEAARAADAECEEIPGRWITRSTPPEGSDSTAPSTQEPEAPPEQDLIASTVAGVVTTVMGSSQPVVTRGTTDNPKFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPR

SEQ ID NO: 2007 - protein, 658 aa, Artificial Sequence
  source: /note="Description of Artificial Sequence: Synthetic Chimeric Antigen Receptor sequence"
MEAPAQLLFLLLLWLPDTTGEIVLTQSPATLSLSPGERATLSCSASSSINYIYWLQQKPGQAPRILIYLTSNLASGVPARFSGSGSGTDFTLTISSLEPEDFAVYYCLQWSSNPLTFGGGTKVEIKRGGGGSGGGGSEVQLVESGGGLVKPGGSLRLSCAASGFTFSSYDMSWVRQAPGKGLEWVSTISSGGSYTYYLDSIKGRFTISRDNAKNSLYLQMNSLRAEDTAVYYCARQGLDYWGRGTLVTVSSGDPKEACPTGLYTHSGECCKACNLGEGVAQPCGANQTVCEPCLDSVTFSDVVSATEPCKPCTECVGLQSMSAPCVEADDAVCRCAYGYYQDETTGRCEACRVCEAGSGLVFSCQDKQNTVCEECPDGTYSDEANHVDPCLPCTVCEDTERQLRECTRWADAECEEIPGRWITRSTPPEGSDSTAPSTQEPEAPPEQDLIASTVAGVVTTVMGSSQPVVTRGTTDNPKFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2008 - protein, 668 aa, Artificial Sequence
  source: /note="Description of Artificial Sequence: Synthetic Chimeric Antigen Receptor sequence"
MEAPAQLLFLLLLWLPDTTGEIVLTQSPATLSLSPGERATLSCSASSSINYIYWLQQKPGQAPRILIYLTSNLASGVPARFSGSGSGTDFTLTISSLEPEDFAVYYCLQWSSNPLTFGGGTKVEIKRGGGGSGGGGSGGGGSGGGGSEVQLVESGGGLVKPGGSLRLSCAASGFTFSSYDMSWVRQAPGKGLEWVSTISSGGSYTYYLDSIKGRFTISRDNAKNSLYLQMNSLRAEDTAVYYCARQGLDYWGRGTLVTVSSGDPKEACPTGLYTHSGECCKACNLGEGVAQPCGANQTVCEPCLDSVTFSDVVSATEPCKPCTECVGLQSMSAPCVEADDAVCRCAYGYYQDETTGRCEACRVCEAGSGLVFSCQDKQNTVCEECPDGTYSDEANHVDPCLPCTVCEDTERQLRECTRWADAECEEIPGRWITRSTPPEGSDSTAPSTQEPEAPPEQDLIASTVAGVVTTVMGSSQPVVTRGTTDNPKFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2009 - protein, 708 aa, Artificial Sequence [sequence omitted]

SEQ ID NO: 2010 - protein, 526 aa, Artificial Sequence
  source: /note="Description of Artificial Sequence: Synthetic Chimeric Antigen Receptor sequence"
MALPVTALLLPLALLLHAARPDIQVTQSPSSLSASLGERISLTCRTSQDISNYLNWFQQKPDGTFKRLIYATSSLDSGVPKRFSGSGSGSDYSLTISSLESEDFADYYCLQYASYPFTFGSGTKLEIKGGGGSGGGGSGGGGSEVQLQESGPGLVKPSQTLSLTCSVTGYSITSGYYWHWIRQFPGNKLQWMGYISYSGFTNYKTSLINRISITHDTSENQFFLNLNSVTTEDTATYYCAGDRTGSWFAYWGQGTLVTVSATTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSKRGRKKLLYIFKQPFMRPVQTTQEEDGCSCRFPEEEEGGCELRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPR

SEQ ID NO: 2011 - protein, 529 aa, Artificial Sequence
  source: /note="Description of Artificial Sequence: Synthetic Chimeric Antigen Receptor sequence"
MALPVTALLLPLALLLHAARPDIQMTQSPSSLSASVGDRVTITCKASQNIDKYLNWYQQKPGKAPKLLIYNTNNLQTGVPSRFSGSGSGTDFTFTISSLQPEDIATYYCLQHISRPRTFGQGTKVEIKGGGGSGGGGSGGGGSQVQLQESGPGLVRPSQTLSLTCTVSGFTFTDFYMNWVRQPPGRGLEWIGFIRDKAKGYTTEYNPSVKGRVTMLVDTSKNQFSLRLSSVTAADTAVYYCAREGHTAAPFDYWGQGSLVTVSSTTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSKRGRKKLLYIFKQPFMRPVQTTQEEDGCSCRFPEEEEGGCELRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPR

SEQ ID NO: 2012 - protein, 686 aa, Artificial Sequence
  source: /note="Description of Artificial Sequence: Synthetic Chimeric Antigen Receptor sequence"
MEFGLSWLFLVAILKGVQCIDAMGNIQLVQSGPELKKPGETVKISCKASGYTFTNYGMNWVKQAPGKGLRWMGWINTHTGEPTYADDFKGRFAFSLETSASTAYLQINNLKNEDTATYFCTRRGYDWYFDVWGAGTTVTVSSGGGGSGGGGSGGGGSDIKMTQSPSSMYASLGERVTITCKASQDINSYLSWFHHKPGKSPKTLIYRANRLVDGVPSRFSGSGSGQDYSLTISSLDYEDMGIYYCQQYDESPWTFGGGTKLEMKGSGDPAEPKSPDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKKDPKFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2013 - protein, 540 aa, Artificial Sequence
  source: /note="Description of Artificial Sequence: Synthetic Chimeric Antigen Receptor sequence"
MALPVTALLLPLALLLHAARPGAQPAMAAYKDIQMTQTTSSLSASLGDRVTISCSASQGISNYLNWYQQKPDGTNKLLIYYTSSLHSGVPSRFSGSGSGTDYSLHSNLEPEDIATYYCQQYSKLPYTFGGGTKLEIKRGGGGSGGGGSGGGGSGGGGSEVQLVESGGGLVKPGGSLKLSCAASGLTFSSYAMSWNRQTPEKRLEWVASISSGGFTYYPDSNKGRFTISRDNARNILYLQMSSLRSEDTAMYYCARDEVRGYLDVWGAGTTVTVSSTTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSKRGRKKLLYIFKQPFMRPVQTTQEEDGCSCRFPEEEEGGCELRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPR

SEQ ID NO: 2014 - protein, 244 aa, Artificial Sequence
  source: /note="Description of Artificial Sequence: Synthetic Chimeric Antigen Receptor sequence"
GVHSQVQLQESGPGLVRPSQTLSLTCTVSGFTISSGYSWHWVRQPPGRGLEWIGYIQYSGITNYNPSLKSRVTMLVDTSKNQFSLRLSSVTAADTAVYYCAREDYDYHWYFDVWGQGTTVTVSSGGGGSGGGGSGGGGSDIQLTQSPSSLSASVGDRVTITCSTSSSVSYMHWYQQKPGKAPKLLIYSTSNLASGVPSRFSGSGSGTDFTFTISSLQPEDIATYYCHQWSSYPTFGQGTKVEIK

SEQ ID NO: 2015 - protein, 459 aa, Artificial Sequence
  source: /note="Description of Artificial Sequence: Synthetic Chimeric Antigen Receptor sequence"
MALPVTALLLPLALLLHAARPQVQLVESGGGVVQPGRSLRLSCAASGFTFSSYGMHWVRQAPGKGLEWVAVIWYDGSDKYFADSVKGRFTISRDNSKNTLYLQMNSLRAEDTAVYYCARDGIAGARYVYFDYWGQGTLVTVSSGGGGSGGGGSGGGGSDIQMTQSPSSLSASVGDRVTITCRASQGISNYLAWFQQKPGKAPKSLIYAASSLQGGVPSKFSGSGSGTDFTLTISSLQPEDFATYYCQQYYNYPFTFGPGTTVDIKGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2016 - protein, 464 aa, Artificial Sequence
  source: /note="Description of Artificial Sequence: Synthetic Chimeric Antigen Receptor sequence"
MALPVTALLLPLALLLHAARPQVQLVESGGGVVQPGRSLRLSCAASGFTFSNYGIHWVRQAPGKGLEWVAVIWYDGSNKYYADSVKGRFTISRDNSKNTLYLQMNSLRAEDTAVYYCARDGGYSGYDSGFDYWGQGTLVTVSSGGGGSGGGGSGGGGSDIVMTQSPLSLPVTPGEPASISCRSSQSLLNSNGYNYLDWYLQKPGQSPQFLIYLGSYRASGVPDRFSGSGSGTDFTLRISRVEAEDVGVYYCIQTLQTPFTFGPGTKVDIKGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2017 - protein, 493 aa, Artificial Sequence
  source: /note="Description of Artificial Sequence: Synthetic Chimeric Antigen Receptor sequence"
MALPVTALLLPLALLLHAARPQVQLVESGGGVVQPGRSLRLSCAASGFTFSNYGIHWVRQAPGKGLEWVAVIWYDGSNKYYADSVKGRFTISRDNSKNTLYLQMNSLRAEDTAVYYCARDGGYSGYDSGFDYWGQGTLVTVSSGGGGSGGGGSGGGGSDIVMTQSPLSLPVTPGEPASISCRSSQSLLNSNGYNYLDWYLQKPGQSPQFLIYLGSYRASGVPDRFSGSGSGTDFTLRISRVEAEDVGVYYCIQTLQTPFTFGPGTKVDIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2018 - protein, 488 aa, Artificial Sequence
  source: /note="Description of Artificial Sequence: Synthetic Chimeric Antigen Receptor sequence"
MALPVTALLLPLALLLHAARPQVQLVESGGGVVQPGRSLRLSCAASGFTFSSYGMHWVRQAPGKGLEWVAVIWYDGSDKYFADSVKGRFTISRDNSKNTLYLQMNSLRAEDTAVYYCARDGIAGARYVYFDYWGQGTLVTVSSGGGGSGGGGSGGGGSDIQMTQSPSSLSASVGDRVTITCRASQGISNYLAWFQQKPGKAPKSLIYAASSLQGGVPSKFSGSGSGTDFTLTISSLQPEDFATYYCQQYYNYPFTFGPGTTVDIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2019 - protein, 584 aa, Artificial Sequence
  source: /note="Description of Artificial Sequence: Synthetic Chimeric Antigen Receptor sequence"
MALPVTALLLPLALLLHAARPQVQLVESGGGVVQPGRSLRLSCAASGFTFSNYGIHWVRQAPGKGLEWVAVIWYDGSNKYYADSVKGRFTISRDNSKNTLYLQMNSLRAEDTAVYYCARDGGYSGYDSGFDYWGQGTLVTVSSGGGGSGGGGSGGGGSDIVMTQSPLSLPVTPGEPASISCRSSQSLLNSNGYNYLDWYLQKPGQSPQFLIYLGSYRASGVPDRFSGSGSGTDFTLRISRVEAEDVGVYYCIQTLQTPFTFGPGTKVDIKEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYCKRGRKKLLYIFKQPFMRPVQTTQEEDGCSCRFPEEEEGGCELRVKFSRSADAPAYQQGQ

SEQ ID NO: 2020 - protein, 674 aa, Artificial Sequence
  source: /note="Description of Artificial Sequence: Synthetic Chimeric Antigen Receptor sequence"
MALPVTALLLPLALLLHAARPQIQLVQSGPEVKKPGETVKISCKASGYTFTNYGMNWVKQAPGKGLKWMGINTYTGEPTYADAFKGRFAFSLETSASTAYLQINNLKNEDTATYFCARDYGDYGMDYWGQGTSVTVSSGGGGSGGGGSGGGGSDIVLTQSPASLAVSLGQRATISCRASKSVSTSGYSFMHWYQQKPGQPPKLLIYLASNLESGVPARFSGSGSGTDFTLNIHPVEEEDAATYYCQHSREVPWTFGGGTKLEIKREPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2021 - protein, 674 aa, Artificial Sequence
  source: /note="Description of Artificial Sequence: Synthetic Chimeric Antigen Receptor sequence"
MALPVTALLLPLALLLHAARPQVQLVESGGGVVQPGRSLRLSCAASGFTFSSYGMHWVRQAPGKGLEWVAVIWYDGSDKYFADSVKGRFTISRDNSKNTLYLQMNSLRAEDTAVYYCARDGIAGARYVYFDYWGQGTLVTVSSGGGGSGGGGSGGGGSDIQMTQSPSSLSASVGDRVTITCRASQGISNYLAWFQQKPGKAPKSLIYAASSLQGGVPSKFSGSGSGTDFTLTISSLQPEDFATYYCQQYYNYPFTFGPGTTVDIKEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2022 - protein, 741 aa, Artificial Sequence
  source: /note="Description of Artificial Sequence: Synthetic Chimeric Antigen Receptor sequence"
AQLEKELQALEKENAQLEWELQALEKELAQSGGGGSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRRAEGRGSLLTCGDVEENPGPMAVPTQVLGLLLLWLTDARCDIQMTQSPSSLSASVGDRVTITCRASEDIYFNLVWYQQKPGKAPKLLIYDTNRLADGVPSRFSGSGSGTQYTLTISSLQPEDFATYYCQHYKNYPLTFGQGTKLEIKRSGGGGSGGGGSGGGGSRSEVQLVESGGGLVQPGGSLRLSCAASGFTLSNYGMHWIRQAPGKGLEWVSSISLNGGSTYYRDSVKGRFTISRDNAKSTLYLQMNSLRAEDTAVYYCAAQDAYTGGYFDYWGQGTLVTVSSMPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKMALIVLGGVAGLLLFIGLGIFFMALIVLGGVAGLLLFIGLGIFFCVRCRHRRRSGGGGSAQLEKKLQALKKKNAQLKWKLQALKKKLAQ

SEQ ID NO: 2023 - protein, 455 aa, Artificial Sequence
  source: /note="Description of Artificial Sequence: Synthetic Chimeric Antigen Receptor sequence"
MALPVTALLLPLALLLHAARPQVQLQESGPGLVKPSETLSLTCVVSGGSISSSNWWSWVRQPPGKGLEWIGEIYHSGSPNYNPSLKSRVTISVDKSKNQFSLKLSSVTAADTAVYYCARSSSGGFFDYWGQGTLVTVSSGGGGSGGGGSGGGGSDIQMTQSPSSLSASVGDRVTITCRASQSISSYLNWYQQKPGKAPKLLIYAASSLQSGVPSRFSGSGSGTDFTLTISSLQPEDFATYYCQQSYSTPPTFGQGTKVEIKGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2024 - protein, 719 aa, Artificial Sequence
  source: /note="Description of Artificial Sequence: Synthetic Chimeric Antigen Receptor sequence"
MAPAMESPTLLCVALLFFAPDGVLAMNIFLLSVLLALLPNVFTARVDQTPRTATKETGESLTINCVLRDTSCAFSSTGWYRTKLGSTNEQSISIGGRYVETVNKGSKSFSLRISDLRVEDSGTYKCQAYVIATMAPLCYASYSWNEKGAGTVLTVKPGVQPSPPVISLLYSATEEQRGNGFVQLICLISGYYFFIPLLVVILFAVDTGLFISTQQQVTFLLKIKRTRKGFRLLNPHPKPNPKNNRAEGRGSLLTCGDVEENPGPMDTESNRRANLALPQEPSSVPAFEVLEISPQEVSSGRLLKSASSPPLHTWLTVLKKEQEFLGVTQILTAMICLCFGTVVCSVLDISHIEGDIFSSFKAGYPFWGAIFFSISGMLSIISERRNATYLVRGSLGANTASSIAGGTGITILIINLKKSLAYIHIHSCQKFFETKCFMASFSTEIVVMMLFLTILGLGSAVSLTICGAGEELKGNKVPEKRGRKKLLYIFKQPFMRPVQTTQEEDGCSCRFPEEEEGGCELGSGVKQTLNFDLLKLAGDVESNPGPMIPAVVLLLLLLVEQAAALGEPQLCYILDAILFLYGIVLTLLYCRLKIQVRKAAITSYEKSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2025 - protein, 513 aa, Artificial Sequence
  source: /note="Description of Artificial Sequence: Synthetic Chimeric Antigen Receptor sequence"
MSVPTQVLGLLLLWLTGARCDIQMTQSPASLSASVGDTVTITCRASENIYSYLAWYQQKQGKSPQLLVYNAKALSEGVPSRFSGSGSGTQFSLRINSLQPEDFGDYYCQHHYNSPYTFGGGTKLEIKGSTSGSGKSSEGKGQIQLVQSGPELKKPGETVKISCKASGYSFTNDGINWVKQAPGKGFKYMGWINTITGEPTYTEDFKGRFAFSLETSASTAYLQINNLKDEDTATFFCAKGTGTSAYWGQGTLVTVSATSLSNSIMYFSHFVPVFLPAKPTTTPAPRPPTPAPTIASQPLSLRPEACRPAAGGAVHTRGLDSRFWVLVVVGGVLACYSLLVTVAFIIFWVRLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRRSQCMWPRETQLLLEVPPSTEDARSCQFPEEERGERSAEEKGRLGDLWV

SEQ ID NO: 2026 - protein, 553 aa, Artificial Sequence
  source: /note="Description of Artificial Sequence: Synthetic Chimeric Antigen Receptor sequence"
MSVPTQVLGLLLLWLTGARCDIQMTQSPASLSASVGDTVTITCRASENIYSYLAWYQQKQGKSPQLLVYNAKALSEGVPSRFSGSGSGTQFSLRINSLQPEDFGDYYCQHHYNSPYTFGGGTKLEIKGSTSGSGKSSEGKGQIQLVQSGPELKKPGETVKISCKASGYSFTNDGINWVKQAPGKGFKYMGWINTITGEPTYTEDFKGRFAFSLETSASTAYLQINNLKDEDTATFFCAKGTGTSAYWGQGTLVTVSATSLSNSIMYFSHFVPVFLPAKPTTTPAPRPPTPAPTIASQPLSLRPEACRPAAGGAVHTRGLDSRFWVLVVVGGVLACYSLLVTVAFIIFWVRLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRRSQCMWPRETQLLLEVPPSTEDARSCQFPEEERGERSAEEKGRLGDLWVSKRSRLLHSDYMNMTPRRPGPTRKHYQPYAPPRDFAAYRS

SEQ ID NO: 2027 - protein, 793 aa, Artificial Sequence
  source: /note="Description of Artificial Sequence: Synthetic Chimeric Antigen Receptor sequence"
MVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYKSGVKQTLNFDLLKLAGDVESNPGPMALPVTALLLPLALLLHAARPDIQMTQSPASLSASVGETVTITCRASENIDSYLAWYQQKQGKSPQLLVYASTLLVDGVPSRFSGSRSGTQFSLKINSLQSEDVARYYCQHYYSIPYTFGSGTKLEIKGGGGSGGGGSGGGGSEVKLVESGGGLVKPGGSLKLSCAASGFTFNSYTMSWVRQTPAKRLEWVVTISSGGGRTYYPDSVKGRFTISRDNARNTLYLQMSSLRSEDTAMYYCIRGDYRYDGFAYWGQGTVVTVSTTTTPAPRPPTPAPTIASQPLSLRPEACRPAAGGAVHTRGLDFACDFWVLVVVGGVLACYSLLVTVAFIIFWVRSKRSRLLHSDYMNMTPRRPGPTRKHYQPYAPPRDFAAYRSKRGRKKLLYIFKQPFMRPVQTTQEEDGCSCRFPEEEEGGCELRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPR

SEQ ID NO: 2028 - protein, 918 aa, Artificial Sequence
  source: /note="Description of Artificial Sequence: Synthetic Chimeric Antigen Receptor sequence"
MAPAMESPTLLCVALLFFAPDGVLAMNIFLLSVLLALLPNVFTARVDQTPRTATKETGESLTINCVLRDTSCAFSSTGWYRTKLGSTNEQSISIGGRYVETVNKGSKSFSLRISDLRVEDSGTYKCQAYVIATMAPLCYASYSWNEKGAGTVLTVKEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKKDPKFFIPLLVVILFAVDTGLFISTQQQVTFLLKIKRTRKGFRLLNPHPKPNPKNNRAEGRGSLLTCGDVEENPGPMDTESNRRANLALPQEPSSVPAFEVLEISPQEVSSGRLLKSASSPPLHTWLTVLKKEQEFLGVTQILTAMICLCFGTVVCSVLDISHIEGDIFSSFKAGYPFWGAIFFSISGMLSIISERRNATYLVRGSLGANTASSIAGGTGITILIINLKKSLAYIHIHSCQKFFETKCFMASFSTEIVVMMLFLTILGLGSAVSLTICGAGEELKGNKVPEKRGRKKLLYIFKQPFMRPVQTTQEEDGCSCRFPEEEEGGCELGSGVKQTLNFDLLKLAGDVESNPGPMIPAVVLLLLLLVEQAAALGEPQLCYILDAILFLYGIVLTLLYCRLKIQVRKAAITSYEKSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2029 - protein, 728 aa, Artificial Sequence
  source: /note="Description of Artificial Sequence: Synthetic Chimeric Antigen Receptor sequence"
MAPAMESPTLLCVALLFFAPDGVLAMNIFLLSVLLALLPNVFTARVDQTPRTATKETGESLTINCVLRDTSCAFSSTGWYRTKLGSTNEQSISIGGRYVETVNKGSKSFSLRISDLRVEDSGTYKCQAYVIATMAPLCYASYSWNEKGAGTVLTVKTTTPAPRPPTPAPTIASQPLSLRPEACRPAAGGAVHTRGLDFACDFFIPLLVVILFAVDTGLFISTQQQVTFLLKIKRTRKGFRLLNPHPKPNPKNNRAEGRGSLLTCGDVEENPGPMDTESNRRANLALPQEPSSVPAFEVLEISPQEVSSGRLLKSASSPPLHTWLTVLKKEQEFLGVTQILTAMICLCFGTVVCSVLDISHIEGDIFSSFKAGYPFWGAIFFSISGMLSIISERRNATYLVRGSLGANTASSIAGGTGITILIINLKKSLAYIHIHSCQKFFETKCFMASFSTEIVVMMLFLTILGLGSAVSLTICGAGEELKGNKVPEKRGRKKLLYIFKQPFMRPVQTTQEEDGCSCRFPEEEEGGCELGSGVKQTLNFDLLKLAGDVESNPGPMIPAVVLLLLLLVEQAAALGEPQLCYILDAILFLYGIVLTLLYCRLKIQVRKAAITSYEKSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2030 - protein, 370 aa, Artificial Sequence
  source: /note="Description of Artificial Sequence: Synthetic Chimeric Antigen Receptor sequence"
MAPAMESPTLLCVALLFFAPDGVLAMNIFLLSVLLALLPNVFTARVDQTPRTATKETGESLTINCVLRDTSCAFSSTGWYRTKLGSTNEQSISIGGRYVETVNKGSKSFSLRISDLRVEDSGTYKCQAYVIATMAPLCYASYSWNEKGAGTVLTVKPGVQPSPPVISLLYSATEEQRGNGFVQLICLISGYYIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2031 - protein, 569 aa, Artificial Sequence
  source: /note="Description of Artificial Sequence: Synthetic Chimeric Antigen Receptor sequence"
MAPAMESPTLLCVALLFFAPDGVLAMNIFLLSVLLALLPNVFTARVDQTPRTATKETGESLTINCVLRDTSCAFSSTGWYRTKLGSTNEQSISIGGRYVETVNKGSKSFSLRISDLRVEDSGTYKCQAYVIATMAPLCYASYSWNEKGAGTVLTVKEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKKDPKIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2032 - protein, 379 aa, Artificial Sequence
  source: /note="Description of Artificial Sequence: Synthetic Chimeric Antigen Receptor sequence"
MAPAMESPTLLCVALLFFAPDGVLAMNIFLLSVLLALLPNVFTARVDQTPRTATKETGESLTINCVLRDTSCAFSSTGWYRTKLGSTNEQSISIGGRYVETVNKGSKSFSLRISDLRVEDSGTYKCQAYVIATMAPLCYASYSWNEKGAGTVLTVKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2033 - protein, 743 aa, Artificial Sequence
  source: /note="Description of Artificial Sequence: Synthetic Chimeric Antigen Receptor sequence"
VQIEYLAKQIVDNAIQQASGGGGSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRRAEGRGSLLTCGDVEENPGPMAVPTQVLGLLLLWLTDARCDIQMTQSPSSLSASVGDRVTITCRASEDIYFNLVWYQQKPGKAPKLLIYDTNRLADGVPSRFSGSGSGTQYTLTISSLQPEDFATYYCQHYKNYPLTFGQGTKLEIKRSGGGGSGGGGSGGGGSRSEVQLVESGGGLVQPGGSLRLSCAASGFTLSNYGMHWIRQAPGKGLEWVSSISLNGGSTYYRDSVKGRFTISRDNAKSTLYLQMNSLRAEDTAVYYCAAQDAYTGGYFDYWGQGTLVTVSSMPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKMALIVLGGVAGLLLFIGLGIFFMALIVLGGVAGLLLFIGLGIFFCVRCRHRRRSGGGGSSHIQIPPGLTELLQGYTVEVLRQQPPDLVEFAVEYFTRLREARA

SEQ ID NO: 2034 - protein, 493 aa, Artificial Sequence
  source: /note="Description of Artificial Sequence: Synthetic Chimeric Antigen Receptor sequence"
MALPVTALLLPLALLLHAARPEVQLVQSGAEVKKPGASVKMSCKASGYTFTSYFIHWVRQAPGQGLEWIGFINPYNDGSKYAQKFQGRATLTSDKSTSTVYMELSSLRSEDTAVYYCTRDDGYYGYAMDYWGQGTLVTVSSASGGGGSGGGGSGGGGSDIQMTQSPSSLSASVGDRVTLTCRATQELSGYLSWLQQKPGKAIKRLIYAASTLDSGVPSRFSGNRAGTDYTLTISSLQPEDFATYYCLQYAIYPYTFGQGTKLEIKRTRTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELSARVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2035 - protein, 704 aa, Artificial Sequence
  source: /note="Description of Artificial Sequence: Synthetic Chimeric Antigen Receptor sequence"
MVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYKSGVKQTLNFDLLKLAGDVESNPGPMALPVTALLLPLALLLHAARPEVKLVESGGGLVKPGGSLKLSCAASGFTFNSYTMSWVRQTPAKRLEWVVTISSGGGRTYYPDSVKGRFTISRDNARNTLYLQMSSLRSEDTAMYYCIRGDYRYDGFAYWGQGTVVTVSTGGGGSGGGGSGGGGSDIQMTQSPASLSASVGETVTITCRASENIDSYLAWYQQKQGKSPQLLVYASTLLVDGVPSRFSGSRSGTQFSLKINSLQSEDVARYYCQHYYSIPYTFGSGTKLEIKTTTPAPRPPTPAPTIASQPLSLRPEACRPAAGGAVHTRGLDFACDIYIWAPLAGTCGVLLLSLVITRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPR

SEQ ID NO: 2036 - protein, 793 aa, Artificial Sequence
  source: /note="Description of Artificial Sequence: Synthetic Chimeric Antigen Receptor sequence"
MVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYKSGVKQTLNFDLLKLAGDVESNPGPMALPVTALLLPLALLLHAARPEVKLVESGGGLVKPGGSLKLSCAASGFTFNSYTMSWVRQTPAKRLEWVVTISSGGGRTYYPDSVKGRFTISRDNARNTLYLQMSSLRSEDTAMYYCIRGDYRYDGFAYWGQGTVVTVSTGGGGSGGGGSGGGGSDIQMTQSPASLSASVGETVTITCRASENIDSYLAWYQQKQGKSPQLLVYASTLLVDGVPSRFSGSRSGTQFSLKINSLQSEDVARYYCQHYYSIPYTFGSGTKLEIKTTTPAPRPPTPAPTIASQPLSLRPEACRPAAGGAVHTRGLDFACDFWVLVVVGGVLACYSLLVTVAFIIFWVRSKRSRLLHSDYMNMTPRRPGPTRKHYQPYAPPRDFAAYRSKRGRKKLLYIFKQPFMRPVQTTQEEDGCSCRFPEEEEGGCELRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPR

SEQ ID NO: 2037 - protein, 453 aa, Artificial Sequence
  source: /note="Description of Artificial Sequence: Synthetic Chimeric Antigen Receptor sequence"
MALPVTALLLPLALLLHAARPEVQLLESGGGLVQPGGSLRLSCAASGFTFSSYAMNWVRQAPGKGLEWVSAISDSGGSRWYADSVKGRFTISRDNSKNTLYLQMNSLRAEDTAVYYCTRYWPMDIWGQGTLVTVSSGGGGSGGGGSGGGGSEIVLTQSPGTLSLSPGERATLSCRASVRVSSTYLAWYQQKPGQAPRLLMYDASIRATGIPDRFSGSGSGTDFTLTISRLEPEDFAVYYCQQYMKWPLTFGQGTKVEIKGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2038 - protein, 455 aa, Artificial Sequence
  source: /note="Description of Artificial Sequence: Synthetic Chimeric Antigen Receptor sequence"
MALPVTALLLPLALLLHAARPQVQLQESGPGLVKPSETLSLTCVVSGGSISSSNWWSWVRQPPGKGLEWIGEIYHSGSPNYNPSLKSRVTISVDKSKNQFSLKLSSVTAADTAVYYCARQTTAGSFDYWGQGTLVTVSSGGGGSGGGGSGGGGSDIQMTQSPSSLSASVGDRVTITCRASQSISSYLNWYQQKPGKAPKLLIYAASSLQSGVPSRFSGSGSGTDFTLTISSLQPEDFATYYCQQSYSTPPTFGQGTKVEIKGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2039 - protein, 456 aa, Artificial Sequence
  source: /note="Description of Artificial Sequence: Synthetic Chimeric Antigen Receptor sequence"
MALPVTALLLPLALLLHAARPQVQLQQPGAELVKPGTSVKLSCKASGYTFTRYWMHWVKQRPGQGLEWIGMIHPSSGSTSYNEKVKNKATLTVDRSSTTAYMQLSSLTSEDSAVYYCARDGDYYYGTGDYWGQGTTLTVSSGGGGSGGGGSGGGGSQIVLSQSPAILSASPGEKVTMTCRASSSINYMHWYQQKPGSSPKPWIFATSNLASGVPSRFSGSGSGTSYSLTISRVEAEDAATYYCQQWRSDRALTFGAGTKLELGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2040 - protein, 457 aa, Artificial Sequence
  source: /note="Description of Artificial Sequence: Synthetic Chimeric Antigen Receptor sequence"
MALPVTALLLPLALLLHAARPEVQLQQSGAELVRPGASVKLSCTASGFNIKDDYIHWVKQRPEQGLEWIGWIDPEKGDTAYASKFQDKATITSDTSSNTAYLQLSSLTSEDTAVYYCTLTGRFDYWGQGTTLTVSSGGGGSGGGGSGGGGSDIVMSQSPSSLAVSVGEKVTMSCKSSQSLLYSSNQKNNLAWYQQKPGQSPKLLIYWASTRESGVPDRFTGSGSGTDFTLTISSVQAEDLAVYYCQQYYSYRTFGGGTKLEIKGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2041 - protein, 457 aa, Artificial Sequence
  source: /note="Description of Artificial Sequence: Synthetic Chimeric Antigen Receptor sequence"
MALPVTALLLPLALLLHAARPEVQLQQSGPELVKPGASVKMSCKASGYIFTSYVMYWVKQKPGQGLEWIGYINPYNDGTKYNEKFKGKATLTSDKSSSTAYMELSSLTSEDSAVYYSCCARYYDYDYYFDYWGQGTTLTVSSGGGGSGGGGSGGGGSDIQMTQSPSSLSASLGGKVTITCKASQDINKYIAWYQHKPGKGPRLLIHYTSTLQPGIPSRFSGSGSGRDYSFSISNLEPEDIATYYCLQYDYLWTFGGGTKLEIKGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2042 - protein, 458 aa, Artificial Sequence
  source: /note="Description of Artificial Sequence: Synthetic Chimeric Antigen Receptor sequence"
MALPVTALLLPLALLLHAARPEVQLQQSGPELVKPGASVKMSCKASGYTFTSYFIHWVKQKPGQGLEWIGFINPYNDGSKYNEKFKGKATLTSDKSSSTAYMELSSLTSEDSAVYYCTRDDGYYGYAMDYWGQGTSVTVSSGGGGSGGGGSGGGGSDIQMTQSPSSLSASLGERVSLTCRATQELSGYLSWLQQKPDGTIKRLIYAASTLDSGVPKRFSGNRSGSDYSLTISSLESEDFADYYCLQYAIYPYTFGGGTKLEIKRGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2043 - protein, 458 aa, Artificial Sequence
  source: /note="Description of Artificial Sequence: Synthetic Chimeric Antigen Receptor sequence"
MALPVTALLLPLALLLHAARPEVQLRQSGPELVKPGASVKMSCKASGYTFTSYFMHWVKQKPGQGLEWIGFINPYNDGTKYNEKFKGKATLTSDKSSSTAYMELNSLTSEDSAVYYCTRDDGYYDYAMDYWGQGTSVTVSSGGGGSGGGGSGGGGSDIQMTQSPSSLSASLGERVSLTCRASQEISVYLSWLQQKPDGTIKRLIYAASTLDSGVPERFSGSRSGSDYSLTISSLESEDFADYYCLQYASYPYTFGGGTKLEIKRGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2044 - protein, 458 aa, Artificial Sequence
  source: /note="Description of Artificial Sequence: Synthetic Chimeric Antigen Receptor sequence"
MALPVTALLLPLALLLHAARPQVQLQESGPGLVKPSETLSLTCVVSGGSISSSNWWSWVRQPPGKGLEWIGEIYHSGSPNYNPSLKSRVTISVDKSKNQFSLKLSSVTAADTAVYYCARQTTAGSFDYWGQGTLVTVSSGGGGSGGGGSGGGGSDIQMTQSPSSLSASVGDRVTITCRASQSISSYLNWYQQKPGKAPKLLIYAASSLQSGVPSRFSGSGSGTDFTLTISSLQPEDFATYYCQQSYSTPPTFGQGTKVEIKGLAVSTISSFFPPGYQIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2045 - protein, 458 aa, Artificial Sequence
  source: /note="Description of Artificial Sequence: Synthetic Chimeric Antigen Receptor sequence"
MALPVTALLLPLALLLHAARPQVQLQESGPGLVKPSETLSLTCVVSGGSISSSNWWSWVRQPPGKGLEWIGEIYHSGSPNYNPSLKSRVTISVDKSKNQFSLKLSSVTAADTAVYYCARSSSGGFFDYWGQGTLVTVSSGGGGSGGGGSGGGGSDIQMTQSPSSLSASVGDRVTITCRASQSISSYLNWYQQKPGKAPKLLIYAASSLQSGVPSRFSGSGSGTDFTLTISSLQPEDFATYYCQQSYSTPPTFGQGTKVEIKGLAVSTISSFFPPGYQIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2046 - protein, 459 aa, Artificial Sequence
  source: /note="Description of Artificial Sequence: Synthetic Chimeric Antigen Receptor sequence"
MALPVTALLLPLALLLHAARPEVQLQQSGPELVKPGASMKISCKASGYSFTGYTMNWVKQSHEKNLEWIGPINPYNDGTIYNPNFKGKATLTVDKASSTAYMELLSLTSDDPAVYYSCCARTDDYDDYTMDYWGQGTSVTVSSGGGGSGGGGSGGGGSEIQMTQTPSSLSASLGDRVTISCRASHDISNYLNWYQQKPDGTLKLLIYYTSRLHSGVPSRFSGSGSGTDYSLTISNLEQEDIATYFCQQGKTLLWTFGGGTKLEIKGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2047 - protein, 459 aa, Artificial Sequence
  source: /note="Description of Artificial Sequence: Synthetic Chimeric Antigen Receptor sequence"
MALPVTALLLPLALLLHAARPQVQLQQPGAELVKPGTSVKLSCKASGYTFTRYWMHWVKQRPGQGLEWIGMIHPSSGSTSYNEKVKNKATLTVDRSSTTAYMQLSSLTSEDSAVYYCARDGDYYYGTGDYWGQGTTLTVSSGGGGSGGGGSGGGGSQIVLSQSPAILSASPGEKVTMTCRASSSINYMHWYQQKPGSSPKPWIFATSNLASGVPSRFSGSGSGTSYSLTISRVEAEDAATYYCQQWRSDRALTFGAGTKLELGLAVSTISSFFPPGYQIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2048 - protein, 460 aa, Artificial Sequence
  source: /note="Description of Artificial Sequence: Synthetic Chimeric Antigen Receptor sequence"
MALPVTALLLPLALLLHAARPDIQLQESGPGLVKPSQSLSLTCSVTGYSITSAYYWNWIRQFPGNKLEWMGYISYDGRNNYNPSLKNRISITRDTSKNQFFLKLNSVTTEDTATYYCAKEGDYDVGNYYAMDYWGQGTSVTVSSGGGGSGGGGSGGGGSENVLTQSPAIMSASPGEKVTMTCRASSNVISSYVHWYQQRSGASPKLWIYSTSNLASGVPARFSGSGSGTSYSLTISSVEAEDAATYYCQQYSGYPLTFGAGTKLELGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2049 - protein, 460 aa, Artificial Sequence
  source: /note="Description of Artificial Sequence: Synthetic Chimeric Antigen Receptor sequence"
MALPVTALLLPLALLLHAARPEVQLQQSGAELVRPGASVKLSCTASGFNIKDDYIHWVKQRPEQGLEWIGWIDPEKGDTAYASKFQDKATITSDTSSNTAYLQLSSLTSEDTAVYYCTLTGRFDYWGQGTTLTVSSGGGGSGGGGSGGGGSDIVMSQSPSSLAVSVGEKVTMSCKSSQSLLYSSNQKNNLAWYQQKPGQSPKLLIYWASTRESGVPDRFTGSGSGTDFTLTISSVQAEDLAVYYCQQYYSYRTFGGGTKLEIKGLAVSTISSFFPPGYQIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2050 - protein, 460 aa, Artificial Sequence
  source: /note="Description of Artificial Sequence: Synthetic Chimeric Antigen Receptor sequence"
MALPVTALLLPLALLLHAARPEVQLQQSGPELVKPGASVKMSCKASGYIFTSYVMYWVKQKPGQGLEWIGYINPYNDGTKYNEKFKGKATLTSDKSSSTAYMELSSLTSEDSAVYYSCCARYYDYDYYFDYWGQGTTLTVSSGGGGSGGGGSGGGGSDIQMTQSPSSLSASLGGKVTITCKASQDINKYIAWYQHKPGKGPRLLIHYTSTLQPGIPSRFSGSGSGRDYSFSISNLEPEDIATYYCLQYDYLWTFGGGTKLEIKGLAVSTISSFFPPGYQIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2051 - protein, 461 aa, Artificial Sequence
  source: /note="Description of Artificial Sequence: Synthetic Chimeric Antigen Receptor sequence"
MALPVTALLLPLALLLHAARPEVQLQQSGPELVKPGASVKMSCKASGYTFTSYFIHWVKQKPGQGLEWIGFINPYNDGSKYNEKFKGKATLTSDKSSSTAYMELSSLTSEDSAVYYCTRDDGYYGYAMDYWGQGTSVTVSSGGGGSGGGGSGGGGSDIQMTQSPSSLSASLGERVSLTCRATQELSGYLSWLQQKPDGTIKRLIYAASTLDSGVPKRFSGNRSGSDYSLTISSLESEDFADYYCLQYAIYPYTFGGGTKLEIKRGLAVSTISSFFPPGYQIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2052 - protein, 461 aa, Artificial Sequence
  source: /note="Description of Artificial Sequence: Synthetic Chimeric Antigen Receptor sequence"
MALPVTALLLPLALLLHAARPEVQLRQSGPELVKPGASVKMSCKASGYTFTSYFMHWVKQKPGQGLEWIGFINPYNDGTKYNEKFKGKATLTSDKSSSTAYMELNSLTSEDSAVYYCTRDDGYYDYAMDYWGQGTSVTVSSGGGGSGGGGSGGGGSDIQMTQSPSSLSASLGERVSLTCRASQEISVYLSWLQQKPDGTIKRLIYAASTLDSGVPERFSGSRSGSDYSLTISSLESEDFADYYCLQYASYPYTFGGGTKLEIKRGLAVSTISSFFPPGYQIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2053 - protein, 461 aa, Artificial Sequence
  source: /note="Description of Artificial Sequence: Synthetic Chimeric Antigen Receptor sequence"
MALPVTALLLPLALLLHAARPQVQLQQPGAELVKPGASMKMSCKASGYTFPSSNIHWLKQTPGQGLEWIGVIYPGNGDTSYNQKFKDKATLTTDKSSSTAYMQLSSLTSEDSAIYFSCCARVYNWHFDVWGAGTTVTVSSGGGGSGGGGSGGGGSNIVLTQSPASLAVSLGQRATISCRASESVDGYGDIFMLWYQQKPGQPPKLLIYFASNLESGVPARFSGSGSRTDFTLTIDPVEADDAATYYCQQNNEDPYTFGGGTKLEIKRGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2054 - protein, 462 aa, Artificial Sequence
  source: /note="Description of Artificial Sequence: Synthetic Chimeric Antigen Receptor sequence"
MALPVTALLLPLALLLHAARPEVQLQQSGPELVKPGASMKISCKASGYSFTGYTMNWVKQSHEKNLEWIGPINPYNDGTIYNPNFKGKATLTVDKASSTAYMELLSLTSDDPAVYYSCCARTDDYDDYTMDYWGQGTSVTVSSGGGGSGGGGSGGGGSEIQMTQTPSSLSASLGDRVTISCRASHDISNYLNWYQQKPDGTLKLLIYYTSRLHSGVPSRFSGSGSGTDYSLTISNLEQEDIATYFCQQGKTLLWTFGGGTKLEIKGLAVSTISSFFPPGYQIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2055 - protein, 463 aa, Artificial Sequence
  source: /note="Description of Artificial Sequence: Synthetic Chimeric Antigen Receptor sequence"
MALPVTALLLPLALLLHAARPDIQLQESGPGLVKPSQSLSLTCSVTGYSITSAYYWNWIRQFPGNKLEWMGYISYDGRNNYNPSLKNRISITRDTSKNQFFLKLNSVTTEDTATYYCAKEGDYDVGNYYAMDYWGQGTSVTVSSGGGGSGGGGSGGGGSENVLTQSPAIMSASPGEKVTMTCRASSNVISSYVHWYQQRSGASPKLWIYSTSNLASGVPARFSGSGSGTSYSLTISSVEAEDAATYYCQQYSGYPLTFGAGTKLELGLAVSTISSFFPPGYQIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2056 - protein, 463 aa, Artificial Sequence
  source: /note="Description of Artificial Sequence: Synthetic Chimeric Antigen Receptor sequence"
MALPVTALLLPLALLLHAARPEVQLQQSGPELVKPGASVKMSCKASGYTFTSYVMHWVKQKPGQGLEWIGYINPYNDGTKYNEKFKGKATLTSDTSSSTAYMELNSLTSEDSAVYFSCCARPIYFDNDYFDYWGQGTTLKVSSGGGGSGGGGSGGGGSTIVLTQSPASLAVSLGQRATISCRASESVDSYGNSFMHWYQQKPGQPPKLLIYLASNLESGVPARFSGSGSRTDFTLTIDPVEADDAATYYCQQNNYDPWTFGGGTKLEIKGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2057 - protein, 464 aa, Artificial Sequence
  source: /note="Description of Artificial Sequence: Synthetic Chimeric Antigen Receptor sequence"
MALPVTALLLPLALLLHAARPQVQLQQPGAELVKPGASMKMSCKASGYTFPSSNIHWLKQTPGQGLEWIGVIYPGNGDTSYNQKFKDKATLTTDKSSSTAYMQLSSLTSEDSAIYFSCCARVYNWHFDVWGAGTTVTVSSGGGGSGGGGSGGGGSNIVLTQSPASLAVSLGQRATISCRASESVDGYGDIFMLWYQQKPGQPPKLLIYFASNLESGVPARFSGSGSRTDFTLTIDPVEADDAATYYCQQNNEDPYTFGGGTKLEIKRGLAVSTISSFFPPGYQIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2058 - protein, 464 aa, Artificial Sequence
  source: /note="Description of Artificial Sequence: Synthetic Chimeric Antigen Receptor sequence"
MALPVTALLLPLALLLHAARPQVQLQQPGAELVKPGASVKLSCKASGYTFTRYWMHWVKQRPGQGLEWIGNIDPSDTETHYNQQFKDKATLTVDKSSSTAYMQLSSLTSEDSAVYYCAIYYGNPSYYAMDYWGQGTSVTVSSGGGGSGGGGSGGGGSDIVMTQSPSSLTVTAGEKVTMSCKSSQNLLNSGNQKKYLNWYQQKPGQPPKLLIYWASTRESGVPDRFTGSGSGTDFTLTISSVQAEDLAVYFCQNDYSYPFTFGAGTKLELKGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2059 - protein, 466 aa, Artificial Sequence
  source: /note="Description of Artificial Sequence: Synthetic Chimeric Antigen Receptor sequence"
MALPVTALLLPLALLLHAARPEVQLQQSGPELVKPGASVKMSCKASGYTFTSYVMHWVKQKPGQGLEWIGYINPYNDGTKYNEKFKGKATLTSDTSSSTAYMELNSLTSEDSAVYFSCCARPIYFDNDYFDYWGQGTTLKVSSGGGGSGGGGSGGGGSTIVLTQSPASLAVSLGQRATISCRASESVDSYGNSFMHWYQQKPGQPPKLLIYLASNLESGVPARFSGSGSRTDFTLTIDPVEADDAATYYCQQNNYDPWTFGGGTKLEIKGLAVSTISSFFPPGYQIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2060 - protein, 467 aa, Artificial Sequence
  source: /note="Description of Artificial Sequence: Synthetic Chimeric Antigen Receptor sequence"
MALPVTALLLPLALLLHAARPQVQLQQPGAELVKPGASVKLSCKASGYTFTRYWMHWVKQRPGQGLEWIGNIDPSDTETHYNQQFKDKATLTVDKSSSTAYMQLSSLTSEDSAVYYCAIYYGNPSYYAMDYWGQGTSVTVSSGGGGSGGGGSGGGGSDIVMTQSPSSLTVTAGEKVTMSCKSSQNLLNSGNQKKYLNWYQQKPGQPPKLLIYWASTRESGVPDRFTGSGSGTDFTLTISSVQAEDLAVYFCQNDYSYPFTFGAGTKLELKGLAVSTISSFFPPGYQIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2061 - protein, 483 aa, Artificial Sequence
  source: /note="Description of Artificial Sequence: Synthetic Chimeric Antigen Receptor sequence"
MALPVTALLLPLALLLHAARPQVNLRESGGGLVQPGGSLRLSCAASGFTFSSYEMNWVRQAPGKGLEWVSYISSSGSTIYYADSVKGRFTISRDNAKNSLYLQMNSLRAEDTAVYYCAREALGSSWEWGQGTTVTVSSGGGGSGGGGSGGGGSDIQMTQSPSSLSASVGDRVTITCQASQDISNYLNWYQQKPGKAPKLLIYDASNLETGVPSRFSGSGSGTDFTFTISSLQPEDIATYYCQQYDNLPLTFGGGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2062 - protein, 483 aa, Artificial Sequence
  source: /note="Description of Artificial Sequence: Synthetic Chimeric Antigen Receptor sequence"
MALPVTALLLPLALLLHAARPQVQLVESGGGLVQPGGSLRLSCAASGFTFSSYWMSWVRQAPGKGLEWVANINEDGSAKFYVDSVKGRFTISRDNAKNSLYLQMNSLRAEDTAVYFCARDLRSGRYWGQGTLVTVSSGGGGSGGGGSGGGGSEIVLTQSPGTLSLSPGGRATLSCRASQSISGSFLAWYQQKPGQAPRLLIYGASSRATGIPDRFSGSGSGTDFTLTISRLEPEDFAVYYCQQYGSSPPTFGLGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2063 - protein, 484 aa, Artificial Sequence
  source: /note="Description of Artificial Sequence: Synthetic Chimeric Antigen Receptor sequence"
MALPVTALLLPLALLLHAARPQVQLQESGPGLVKPSETLSLTCVVSGGSISSSNWWSWVRQPPGKGLEWIGEIYHSGSPNYNPSLKSRVTISVDKSKNQFSLKLSSVTAADTAVYYCARQTTAGSFDYWGQGTLVTVSSGGGGSGGGGSGGGGSDIQMTQSPSSLSASVGDRVTITCRASQSISSYLNWYQQKPGKAPKLLIYAASSLQSGVPSRFSGSGSGTDFTLTISSLQPEDFATYYCQQSYSTPPTFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2064 - protein, 484 aa, Artificial Sequence
  source: /note="Description of Artificial Sequence: Synthetic Chimeric Antigen Receptor sequence"
MALPVTALLLPLALLLHAARPQVQLQESGPGLVKPSETLSLTCVVSGGSISSSNWWSWVRQPPGKGLEWIGEIYHSGSPNYNPSLKSRVTISVDKSKNQFSLKLSSVTAADTAVYYCARSSSGGFFDYWGQGTLVTVSSGGGGSGGGGSGGGGSDIQMTQSPSSLSASVGDRVTITCRASQSISSYLNWYQQKPGKAPKLLIYAASSLQSGVPSRFSGSGSGTDFTLTISSLQPEDFATYYCQQSYSTPPTFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2065 - protein, 485 aa, Artificial Sequence
  source: /note="Description of Artificial Sequence: Synthetic Chimeric Antigen Receptor sequence"
MALPVTALLLPLALLLHAARPQVQLQQPGAELVKPGTSVKLSCKASGYTFTRYWMHWVKQRPGQGLEWIGMIHPSSGSTSYNEKVKNKATLTVDRSSTTAYMQLSSLTSEDSAVYYCARDGDYYYGTGDYWGQGTTLTVSSGGGGSGGGGSGGGGSQIVLSQSPAILSASPGEKVTMTCRASSSINYMHWYQQKPGSSPKPWIFATSNLASGVPSRFSGSGSGTSYSLTISRVEAEDAATYYCQQWRSDRALTFGAGTKLELTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2066 - protein, 486 aa, Artificial Sequence
  source: /note="Description of Artificial Sequence: Synthetic Chimeric Antigen Receptor sequence"
MALPVTALLLPLALLLHAARPEVQLQQSGAELVRPGASVKLSCTASGFNIKDDYIHWVKQRPEQGLEWIGWIDPEKGDTAYASKFQDKATITSDTSSNTAYLQLSSLTSEDTAVYYCTLTGRFDYWGQGTTLTVSSGGGGSGGGGSGGGGSDIVMSQSPSSLAVSVGEKVTMSCKSSQSLLYSSNQKNNLAWYQQKPGQSPKLLIYWASTRESGVPDRFTGSGSGTDFTLTISSVQAEDLAVYYCQQYYSYRTFGGGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2067 - protein, 486 aa, Artificial Sequence
  source: /note="Description of Artificial Sequence: Synthetic Chimeric Antigen Receptor sequence"
MALPVTALLLPLALLLHAARPEVQLQQSGPELVKPGASVKMSCKASGYIFTSYVMYWVKQKPGQGLEWIGYINPYNDGTKYNEKFKGKATLTSDKSSSTAYMELSSLTSEDSAVYYSCCARYYDYDYYFDYWGQGTTLTVSSGGGGSGGGGSGGGGSDIQMTQSPSSLSASLGGKVTITCKASQDINKYIAWYQHKPGKGPRLLIHYTSTLQPGIPSRFSGSGSGRDYSFSISNLEPEDIATYYCLQYDYLWTFGGGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2068 - protein, 487 aa, Artificial Sequence
  source: /note="Description of Artificial Sequence: Synthetic Chimeric Antigen Receptor sequence"
MALPVTALLLPLALLLHAARPEVQLQQSGPELVKPGASVKMSCKASGYTFTSYFIHWVKQKPGQGLEWIGFINPYNDGSKYNEKFKGKATLTSDKSSSTAYMELSSLTSEDSAVYYCTRDDGYYGYAMDYWGQGTSVTVSSGGGGSGGGGSGGGGSDIQMTQSPSSLSASLGERVSLTCRATQELSGYLSWLQQKPDGTIKRLIYAASTLDSGVPKRFSGNRSGSDYSLTISSLESEDFADYYCLQYAIYPYTFGGGTKLEIKRTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2069 - protein, 487 aa, Artificial Sequence
  source: /note="Description of Artificial Sequence: Synthetic Chimeric Antigen Receptor sequence"
MALPVTALLLPLALLLHAARPEVQLRQSGPELVKPGASVKMSCKASGYTFTSYFMHWVKQKPGQGLEWIGFINPYNDGTKYNEKFKGKATLTSDKSSSTAYMELNSLTSEDSAVYYCTRDDGYYDYAMDYWGQGTSVTVSSGGGGSGGGGSGGGGSDIQMTQSPSSLSASLGERVSLTCRASQEISVYLSWLQQKPDGTIKRLIYAASTLDSGVPERFSGSRSGSDYSLTISSLESEDFADYYCLQYASYPYTFGGGTKLEIKRTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2070 - protein, 487 aa, Artificial Sequence
  source: /note="Description of Artificial Sequence: Synthetic Chimeric Antigen Receptor sequence"
MALPVTALLLPLALLLHAARPQVQLQESGPGLVKPSETLSLTCVVSGGSISSSNWWSWVRQPPGKGLEWIGEIYHSGSPNYNPSLKSRVTISVDKSKNQFSLKLSSVTAADTAVYYCARQTTAGSFDYWGQGTLVTVSSGGGGSGGGGSGGGGSDIQMTQSPSSLSASVGDRVTITCRASQSISSYLNWYQQKPGKAPKLLIYAASSLQSGVPSRFSGSGSGTDFTLTISSLQPEDFATYYCQQSYSTPPTFGQGTKVEIKTTTPAPRPPTPAPTIASQPLSLRPEACRPAAGGAVHTRGLDFACDIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2071 - protein, 487 aa, Artificial Sequence
  source: /note="Description of Artificial Sequence: Synthetic Chimeric Antigen Receptor sequence"
MALPVTALLLPLALLLHAARPQVQLQESGPGLVKPSETLSLTCVVSGGSISSSNWWSWVRQPPGKGLEWIGEIYHSGSPNYNPSLKSRVTISVDKSKNQFSLKLSSVTAADTAVYYCARSSSGGFFDYWGQGTLVTVSSGGGGSGGGGSGGGGSDIQMTQSPSSLSASVGDRVTITCRASQSISSYLNWYQQKPGKAPKLLIYAASSLQSGVPSRFSGSGSGTDFTLTISSLQPEDFATYYCQQSYSTPPTFGQGTKVEIKTTTPAPRPPTPAPTIASQPLSLRPEACRPAAGGAVHTRGLDFACDIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2072 - protein, 488 aa, Artificial Sequence
  source: /note="Description of Artificial Sequence: Synthetic Chimeric Antigen Receptor sequence"
MALPVTALLLPLALLLHAARPEVQLQQSGPELVKPGASMKISCKASGYSFTGYTMNWVKQSHEKNLEWIGPINPYNDGTIYNPNFKGKATLTVDKASSTAYMELLSLTSDDPAVYYSCCARTDDYDDYTMDYWGQGTSVTVSSGGGGSGGGGSGGGGSEIQMTQTPSSLSASLGDRVTISCRASHDISNYLNWYQQKPDGTLKLLIYYTSRLHSGVPSRFSGSGSGTDYSLTISNLEQEDIATYFCQQGKTLLWTFGGGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2073 - protein, 488 aa, Artificial Sequence
  source: /note="Description of Artificial Sequence: Synthetic Chimeric Antigen Receptor sequence"
MALPVTALLLPLALLLHAARPQVQLQQPGAELVKPGTSVKLSCKASGYTFTRYWMHWVKQRPGQGLEWIGMIHPSSGSTSYNEKVKNKATLTVDRSSTTAYMQLSSLTSEDSAVYYCARDGDYYYGTGDYWGQGTTLTVSSGGGGSGGGGSGGGGSQIVLSQSPAILSASPGEKVTMTCRASSSINYMHWYQQKPGSSPKPWIFATSNLASGVPSRFSGSGSGTSYSLTISRVEAEDAATYYCQQWRSDRALTFGAGTKLELTTTPAPRPPTPAPTIASQPLSLRPEACRPAAGGAVHTRGLDFACDIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2074 - protein, 489 aa, Artificial Sequence
  source: /note="Description of Artificial Sequence: Synthetic Chimeric Antigen Receptor sequence"
MALPVTALLLPLALLLHAARPDIQLQESGPGLVKPSQSLSLTCSVTGYSITSAYYWNWIRQFPGNKLEWMGYISYDGRNNYNPSLKNRISITRDTSKNQFFLKLNSVTTEDTATYYCAKEGDYDVGNYYAMDYWGQGTSVTVSSGGGGSGGGGSGGGGSENVLTQSPAIMSASPGEKVTMTCRASSNVISSYVHWYQQRSGASPKLWIYSTSNLASGVPARFSGSGSGTSYSLTISSVEAEDAATYYCQQYSGYPLTFGAGTKLELTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2075 - protein, 489 aa, Artificial Sequence
  source: /note="Description of Artificial Sequence: Synthetic Chimeric Antigen Receptor sequence"
MALPVTALLLPLALLLHAARPEVQLQQSGAELVRPGASVKLSCTASGFNIKDDYIHWVKQRPEQGLEWIGWIDPEKGDTAYASKFQDKATITSDTSSNTAYLQLSSLTSEDTAVYYCTLTGRFDYWGQGTTLTVSSGGGGSGGGGSGGGGSDIVMSQSPSSLAVSVGEKVTMSCKSSQSLLYSSNQKNNLAWYQQKPGQSPKLLIYWASTRESGVPDRFTGSGSGTDFTLTISSVQAEDLAVYYCQQYYSYRTFGGGTKLEIKTTTPAPRPPTPAPTIASQPLSLRPEACRPAAGGAVHTRGLDFACDIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2076 - protein, 489 aa, Artificial Sequence
  source: /note="Description of Artificial Sequence: Synthetic Chimeric Antigen Receptor sequence"
MALPVTALLLPLALLLHAARPEVQLQQSGPELVKPGASVKMSCKASGYIFTSYVMYWVKQKPGQGLEWIGYINPYNDGTKYNEKFKGKATLTSDKSSSTAYMELSSLTSEDSAVYYSCCARYYDYDYYFDYWGQGTTLTVSSGGGGSGGGGSGGGGSDIQMTQSPSSLSASLGGKVTITCKASQDINKYIAWYQHKPGKGPRLLIHYTSTLQPGIPSRFSGSGSGRDYSFSISNLEPEDIATYYCLQYDYLWTFGGGTKLEIKTTTPAPRPPTPAPTIASQPLSLRPEACRPAAGGAVHTRGLDFACDIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2077 - protein, 489 aa, Artificial Sequence
  source: /note="Description of Artificial Sequence: Synthetic Chimeric Antigen Receptor sequence"
MALPVTALLLPLALLLHAARPEVQLQQSGPGLVRPSETLSLTCTVSGGPVRSGSHYWNWIRQPPGRGLEWIGYIYYSGSTNYNPSLENRVTISIDTSNNHFSLKLSSVTAADTALYFCARGTATFDWNFPFDSWGQGTLVTVSSGGGGSGGGGSGSGGSDIQMTQSPSSLSASIGDRVTITCRASQSISSYLNWYQQKPGKAPKLLIYAASSLQSGVPSRFSGSGSGTDFTLTISSLQPEDFATYYCQQSYSTPWTFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2078 - protein, 489 aa, Artificial Sequence
  source: /note="Description of Artificial Sequence: Synthetic Chimeric Antigen Receptor sequence"
MALPVTALLLPLALLLHAARPEVQLVESGGGLVQPGGSLRLSCAASGFTFSSYEMNWVRQAPGKGLEWVSYISSSGSTIYYADSVKGRFTISRDNAKNSLYLQMNSLRAEDTAVYYCARDPYSSSWHDAFDIWGQGTMVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVDIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2079 - protein, 489 aa, Artificial Sequence
  source: /note="Description of Artificial Sequence: Synthetic Chimeric Antigen Receptor sequence"
MALPVTALLLPLALLLHAARPEVQLVESGGGVVQPGGSLRLSCAASGFTFDDYAMHWVRQAPGKGLEWVSLISGDGGSTYYADSVKGRFTISRDNSKNTLYLQMNSLRVEDTAVYYCARVFDSYYMDVWGKGTTVTVSSGGGGSGGGGSGSGGSEIVLTQSPLSLPVTPGQPASISCRSSQSLVYTDGNTYLNWFQQRPGQSPRRLIYKVSNRDSGVPDRFSGSGSDTDFTLKISRVEAEDVGIYYCMQGTHWSFTFGQGTRLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2080 - protein, 490 aa, Artificial Sequence
  source: /note="Description of Artificial Sequence: Synthetic Chimeric Antigen Receptor sequence"
MALPVTALLLPLALLLHAARPEVQLQQSGPELVKPGASVKMSCKASGYTFTSYFIHWVKQKPGQGLEWIGFINPYNDGSKYNEKFKGKATLTSDKSSSTAYMELSSLTSEDSAVYYCTRDDGYYGYAMDYWGQGTSVTVSSGGGGSGGGGSGGGGSDIQMTQSPSSLSASLGERVSLTCRATQELSGYLSWLQQKPDGTIKRLIYAASTLDSGVPKRFSGNRSGSDYSLTISSLESEDFADYYCLQYAIYPYTFGGGTKLEIKRTTTPAPRPPTPAPTIASQPLSLRPEACRPAAGGAVHTRGLDFACDIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2081 - protein, 490 aa, Artificial Sequence
  source: /note="Description of Artificial Sequence: Synthetic Chimeric Antigen Receptor sequence"
MALPVTALLLPLALLLHAARPEVQLRQSGPELVKPGASVKMSCKASGYTFTSYFMHWVKQKPGQGLEWIGFINPYNDGTKYNEKFKGKATLTSDKSSSTAYMELNSLTSEDSAVYYCTRDDGYYDYAMDYWGQGTSVTVSSGGGGSGGGGSGGGGSDIQMTQSPSSLSASLGERVSLTCRASQEISVYLSWLQQKPDGTIKRLIYAASTLDSGVPERFSGSRSGSDYSLTISSLESEDFADYYCLQYASYPYTFGGGTKLEIKRTTTPAPRPPTPAPTIASQPLSLRPEACRPAAGGAVHTRGLDFACDIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2082 - protein, 490 aa, Artificial Sequence
  source: /note="Description of Artificial Sequence: Synthetic Chimeric Antigen Receptor sequence"
MALPVTALLLPLALLLHAARPEVQLVQSGGGVVRSGRSLRLSCAASGFTFNSYGLHWVRQAPGKGLEWVALIEYDGSNKYYGDSVKGRFTISRDKSKSTLYLQMDNLRAEDTAVYYCAREGNEDLAFDIWGQGTLVTVSSGGGGSGGGGSGGGGSGGGGSEIVLTQSPSSLSASVGDRVTITCQASQFIKKNLNWYQHKPGKAPKLLIYDASSLQTGVPSRFSGNRSGTTFSFTISSLQPEDVATYYCQQHDNLPLTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2083 - protein, 490 aa, Artificial Sequence
  source: /note="Description of Artificial Sequence: Synthetic Chimeric Antigen Receptor sequence"
MALPVTALLLPLALLLHAARPQVQLQQPGAELVKPGASMKMSCKASGYTFPSSNIHWLKQTPGQGLEWIGVIYPGNGDTSYNQKFKDKATLTTDKSSSTAYMQLSSLTSEDSAIYFSCCARVYNWHFDVWGAGTTVTVSSGGGGSGGGGSGGGGSNIVLTQSPASLAVSLGQRATISCRASESVDGYGDIFMLWYQQKPGQPPKLLIYFASNLESGVPARFSGSGSRTDFTLTIDPVEADDAATYYCQQNNEDPYTFGGGTKLEIKRTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2084 - protein, 490 aa, Artificial Sequence
  source: /note="Description of Artificial Sequence: Synthetic Chimeric Antigen Receptor sequence"
MALPVTALLLPLALLLHAARPQVQLVQSGAEVKEPGASVKVSCKAPANTFSDHVMHWVRQAPGQRFEWMGYIHAANGGTHYSQKFQDRVTITRDTSANTVYMDLSSLRSEDTAVYYCARGGYNSDAFDIWGQGTMVTVSSGGGGSGGGGSGGGGSGGGGSDIVMTQSPSSVSASVGDRVTITCRASQDISSWLAWYQQKPGKAPKLLIYAASSLQSGVPSRFNGSGSGTDFTLTISSLQPEDFATYYCQQSYSTPLTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2085 - protein, 491 aa, Artificial Sequence
  source: /note="Description of Artificial Sequence: Synthetic Chimeric Antigen Receptor sequence"
MALPVTALLLPLALLLHAARPEVQLQQSGAEVKKPGSSVKVSCKASGGTFSSYAISWVRQAPGQGLEWMGGIIPIFGTANYAQKFQGRVTITADESTSTAYMELSSLRSEDTAVYYCARDLEMATIMGGYWGQGTLVTVSSGGGGSGGGGSGGGGSQSALTQPASVSGSPGQSITISCTGTSSDVGGYNYVSWYQQHPGKAPKLMIYDVSNRPSGVSNRFSGSKSGNTASLTISGLQAEDEADYYCSSYTSSSTLDVVFGGGTKLTVLTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2086 - protein, 491 aa, Artificial Sequence
  source: /note="Description of Artificial Sequence: Synthetic Chimeric Antigen Receptor sequence"
MALPVTALLLPLALLLHAARPEVQLQQSGPELVKPGASMKISCKASGYSFTGYTMNWVKQSHEKNLEWIGPINPYNDGTIYNPNFKGKATLTVDKASSTAYMELLSLTSDDPAVYYSCCARTDDYDDYTMDYWGQGTSVTVSSGGGGSGGGGSGGGGSEIQMTQTPSSLSASLGDRVTISCRASHDISNYLNWYQQKPDGTLKLLIYYTSRLHSGVPSRFSGSGSGTDYSLTISNLEQEDIATYFCQQGKTLLWTFGGGTKLEIKTTTPAPRPPTPAPTIASQPLSLRPEACRPAAGGAVHTRGLDFACDIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2087 - protein, 491 aa, Artificial Sequence
  source: /note="Description of Artificial Sequence: Synthetic Chimeric Antigen Receptor sequence"
MALPVTALLLPLALLLHAARPQVQLQESGPGLVKPSETLSLTCTVSGGSISSSSYYWGWIRQPPGKGLEWIGSIYYSGSTYYNPSLKSRVSISVDTSKNQFSLKLKYVTAADTAVYYCATPGTYYDFLSGYYPFYWGQGTLVTVSSGGGGSGGGGSGGGGSDIVMTQSPSSLSASVGDRVTITCRASQGISSYLAWYQQKPGKAPKLLIYAASTLQSGVPSRFSGSGSGTDFTLTISSLQPEDFATYYCQQLNSYPYTFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2088 - protein, 491 aa, Artificial Sequence
  source: /note="Description of Artificial Sequence: Synthetic Chimeric Antigen Receptor sequence"
MALPVTALLLPLALLLHAARPQVQLVQSGAEVKKSGASVKVSCKASGYPFTGYYIQWVRQAPGQGLEWMGWIDPNSGNTGYAQKFQGRVTMTRNTSISTAYMELSSLRSEDTAVYYCASDSYGYYYGMDVWGQGTLVTVSSGGGGSGGGGSGGGGSGGGGSDIQMTQSPSSLSASVGDRVTFTCRASQGISSALAWYQQKPGKPPKLLIYDASSLESGVPSRFSGSGSGTDFTLTISSLQPEDFATYYCQQFNNYPLTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2089 - protein, 492 aa, Artificial Sequence
  source: /note="Description of Artificial Sequence: Synthetic Chimeric Antigen Receptor sequence"
MALPVTALLLPLALLLHAARPDIQLQESGPGLVKPSQSLSLTCSVTGYSITSAYYWNWIRQFPGNKLEWMGYISYDGRNNYNPSLKNRISITRDTSKNQFFLKLNSVTTEDTATYYCAKEGDYDVGNYYAMDYWGQGTSVTVSSGGGGSGGGGSGGGGSENVLTQSPAIMSASPGEKVTMTCRASSNVISSYVHWYQQRSGASPKLWIYSTSNLASGVPARFSGSGSGTSYSLTISSVEAEDAATYYCQQYSGYPLTFGAGTKLELTTTPAPRPPTPAPTIASQPLSLRPEACRPAAGGAVHTRGLDFACDIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2090 - protein, 492 aa, Artificial Sequence
  source: /note="Description of Artificial Sequence: Synthetic Chimeric Antigen Receptor sequence"
MALPVTALLLPLALLLHAARPEVQLQQSGPELVKPGASVKMSCKASGYTFTSYVMHWVKQKPGQGLEWIGYINPYNDGTKYNEKFKGKATLTSDTSSSTAYMELNSLTSEDSAVYFSCCARPIYFDNDYFDYWGQGTTLKVSSGGGGSGGGGSGGGGSTIVLTQSPASLAVSLGQRATISCRASESVDSYGNSFMHWYQQKPGQPPKLLIYLASNLESGVPARFSGSGSRTDFTLTIDPVEADDAATYYCQQNNYDPWTFGGGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2091 - protein, 492 aa, Artificial Sequence
  source: /note="Description of Artificial Sequence: Synthetic Chimeric Antigen Receptor sequence"
MALPVTALLLPLALLLHAARPQVQLVQSGGGLVQPGGSLRLSCAASGFTFSSYSMNWVRQAPGKGLEWVSYISSSSSTIYYADSVKGRFTISRDNAKNSLYLQMNSLRAEDTAVYYCARDLSVRAIDAFDIWGQGTMVTVSSGGGGSGGGGSGGGGSGGGGSDIVLTQSPSSLSASVGDRVTITCQASQDISNYLNWYQQKPGKAPKLLIYDASNLETGVPSRFSGSGSGTDFTFTISSLQPEDFATYYCQQAYSTPFTFGPGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2092 - protein, 493 aa, Artificial Sequence
  source: /note="Description of Artificial Sequence: Synthetic Chimeric Antigen Receptor sequence"
MALPVTALLLPLALLLHAARPQVQLQESGAGLLKPSETLSLTCAVYGGSFSGYYWSWIRQPPGKGLEWVGEINHSGSTNYNPSLKSRVTISVDTSKNQFSLKLSSVTAADTAVYYCARGSGLVVYAIRVGSGWFDYWGQGTLVTVSSGGGGSGGGDSGGGGSDIQMTQSPSSLSASVGDRVTITCRASQSISSYLNWYQQKPGKAPKLLMYAASSLQSGVPSRFSGSGSGTDFTLTISSLQPEDFATYYCQQSYSTPPWTFGQGTKVDIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2093 - protein, 493 aa, Artificial Sequence
  source: /note="Description of Artificial Sequence: Synthetic Chimeric Antigen Receptor sequence"
MALPVTALLLPLALLLHAARPQVQLQQPGAELVKPGASMKMSCKASGYTFPSSNIHWLKQTPGQGLEWIGVIYPGNGDTSYNQKFKDKATLTTDKSSSTAYMQLSSLTSEDSAIYFSCCARVYNWHFDVWGAGTTVTVSSGGGGSGGGGSGGGGSNIVLTQSPASLAVSLGQRATISCRASESVDGYGDIFMLWYQQKPGQPPKLLIYFASNLESGVPARFSGSGSRTDFTLTIDPVEADDAATYYCQQNNEDPYTFGGGTKLEIKRTTTPAPRPPTPAPTIASQPLSLRPEACRPAAGGAVHTRGLDFACDIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2094 - protein, 493 aa, Artificial Sequence
  source: /note="Description of Artificial Sequence: Synthetic Chimeric Antigen Receptor sequence"
MALPVTALLLPLALLLHAARPQVQLQQPGAELVKPGASVKLSCKASGYTFTRYWMHWVKQRPGQGLEWIGNIDPSDTETHYNQQFKDKATLTVDKSSSTAYMQLSSLTSEDSAVYYCAIYYGNPSYYAMDYWGQGTSVTVSSGGGGSGGGGSGGGGSDIVMTQSPSSLTVTAGEKVTMSCKSSQNLLNSGNQKKYLNWYQQKPGQPPKLLIYWASTRESGVPDRFTGSGSGTDFTLTISSVQAEDLAVYFCQNDYSYPFTFGAGTKLELKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2095 - protein, 495 aa, Artificial Sequence
  source: /note="Description of Artificial Sequence: Synthetic Chimeric Antigen Receptor sequence"
MALPVTALLLPLALLLHAARPEVQLQQSGPELVKPGASVKMSCKASGYTFTSYVMHWVKQKPGQGLEWIGYINPYNDGTKYNEKFKGKATLTSDTSSSTAYMELNSLTSEDSAVYFSCCARPIYFDNDYFDYWGQGTTLKVSSGGGGSGGGGSGGGGSTIVLTQSPASLAVSLGQRATISCRASESVDSYGNSFMHWYQQKPGQPPKLLIYLASNLESGVPARFSGSGSRTDFTLTIDPVEADDAATYYCQQNNYDPWTFGGGTKLEIKTTTPAPRPPTPAPTIASQPLSLRPEACRPAAGGAVHTRGLDFACDIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2096 - protein, 496 aa, Artificial Sequence
  source: /note="Description of Artificial Sequence: Synthetic Chimeric Antigen Receptor sequence"
MALPVTALLLPLALLLHAARPQVQLQQPGAELVKPGASVKLSCKASGYTFTRYWMHWVKQRPGQGLEWIGNIDPSDTETHYNQQFKDKATLTVDKSSSTAYMQLSSLTSEDSAVYYCAIYYGNPSYYAMDYWGQGTSVTVSSGGGGSGGGGSGGGGSDIVMTQSPSSLTVTAGEKVTMSCKSSQNLLNSGNQKKYLNWYQQKPGQPPKLLIYWASTRESGVPDRFTGSGSGTDFTLTISSVQAEDLAVYFCQNDYSYPFTFGAGTKLELKTTTPAPRPPTPAPTIASQPLSLRPEACRPAAGGAVHTRGLDFACDIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2097 - protein, 499 aa, Artificial Sequence
  source: /note="Description of Artificial Sequence: Synthetic Chimeric Antigen Receptor sequence"
MALPVTALLLPLALLLHAARPEVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARDPSSSGSYYMEDSYYYGMDVWGQGTTVTVSSGGGGSGGGGSGGGGSNFMLTQPHSVSESPGKTVTISCTGSSGSIASNYVQWYQQRPGSAPTTVIYEDNQRPSGVPDRFSGSIDSSSNSASLTISGLKTEDEADYYCQSYDSSNQVVFGGGTKLTVLTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2098 - protein, 499 aa, Artificial Sequence
  source: /note="Description of Artificial Sequence: Synthetic Chimeric Antigen Receptor sequence"
MALPVTALLLPLALLLHAARPQVQLVESGGGLVQPGGSLRLSCAASGFNVSSNYMTWVRQAPGKGLEWVSVIYSGGATYYGDSVKGRFTVSRDNSKNTVYLQMNRLTAEDTAVYYCARDRLYCGNNCYLYYYYGMDVWGQGTLVTVSSGGGGSGGGGSGGGGSGGGGSDIQVTQSPSSLSASVGDRVTITCRASQSISSYLNWYQQKPGKAPKLLIYAASSLQSGVPSRFSGSGSGTDFTLTISSLQPEDFATYYCQQSYSTPPLTFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2099 - protein, 670 aa, Artificial Sequence
  source: /note="Description of Artificial Sequence: Synthetic Chimeric Antigen Receptor sequence"
MALPVTALLLPLALLLHAARPQVQLQESGPGLVKPSETLSLTCVVSGGSISSSNWWSWVRQPPGKGLEWIGEIYHSGSPNYNPSLKSRVTISVDKSKNQFSLKLSSVTAADTAVYYCARQTTAGSFDYWGQGTLVTVSSGGGGSGGGGSGGGGSDIQMTQSPSSLSASVGDRVTITCRASQSISSYLNWYQQKPGKAPKLLIYAASSLQSGVPSRFSGSGSGTDFTLTISSLQPEDFATYYCQQSYSTPPTFGQGTKVEIKEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2100 - protein, 670 aa, Artificial Sequence
  source: /note="Description of Artificial Sequence: Synthetic Chimeric Antigen Receptor sequence"
MALPVTALLLPLALLLHAARPQVQLQESGPGLVKPSETLSLTCVVSGGSISSSNWWSWVRQPPGKGLEWIGEIYHSGSPNYNPSLKSRVTISVDKSKNQFSLKLSSVTAADTAVYYCARSSSGGFFDYWGQGTLVTVSSGGGGSGGGGSGGGGSDIQMTQSPSSLSASVGDRVTITCRASQSISSYLNWYQQKPGKAPKLLIYAASSLQSGVPSRFSGSGSGTDFTLTISSLQPEDFATYYCQQSYSTPPTFGQGTKVEIKEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2101 - protein, 671 aa, Artificial Sequence
  source: /note="Description of Artificial Sequence: Synthetic Chimeric Antigen Receptor sequence"
MALPVTALLLPLALLLHAARPQVQLQQPGAELVKPGTSVKLSCKASGYTFTRYWMHWVKQRPGQGLEWIGMIHPSSGSTSYNEKVKNKATLTVDRSSTTAYMQLSSLTSEDSAVYYCARDGDYYYGTGDYWGQGTTLTVSSGGGGSGGGGSGGGGSQIVLSQSPAILSASPGEKVTMTCRASSSINYMHWYQQKPGSSPKPWIFATSNLASGVPSRFSGSGSGTSYSLTISRVEAEDAATYYCQQWRSDRALTFGAGTKLELEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2102 - protein, 672 aa, Artificial Sequence
  source: /note="Description of Artificial Sequence: Synthetic Chimeric Antigen Receptor sequence"
MALPVTALLLPLALLLHAARPEVQLQQSGAELVRPGASVKLSCTASGFNIKDDYIHWVKQRPEQGLEWIGWIDPEKGDTAYASKFQDKATITSDTSSNTAYLQLSSLTSEDTAVYYCTLTGRFDYWGQGTTLTVSSGGGGSGGGGSGGGGSDIVMSQSPSSLAVSVGEKVTMSCKSSQSLLYSSNQKNNLAWYQQKPGQSPKLLIYWASTRESGVPDRFTGSGSGTDFTLTISSVQAEDLAVYYCQQYYSYRTFGGGTKLEIKEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2103 - protein, 672 aa, Artificial Sequence
  source: /note="Description of Artificial Sequence: Synthetic Chimeric Antigen Receptor sequence"
MALPVTALLLPLALLLHAARPEVQLQQSGPELVKPGASVKMSCKASGYIFTSYVMYWVKQKPGQGLEWIGYINPYNDGTKYNEKFKGKATLTSDKSSSTAYMELSSLTSEDSAVYYSCCARYYDYDYYFDYWGQGTTLTVSSGGGGSGGGGSGGGGSDIQMTQSPSSLSASLGGKVTITCKASQDINKYIAWYQHKPGKGPRLLIHYTSTLQPGIPSRFSGSGSGRDYSFSISNLEPEDIATYYCLQYDYLWTFGGGTKLEIKEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2104 - protein, 673 aa, Artificial Sequence
  source: /note="Description of Artificial Sequence: Synthetic Chimeric Antigen Receptor sequence"
MALPVTALLLPLALLLHAARPEVQLQQSGPELVKPGASVKMSCKASGYTFTSYFIHWVKQKPGQGLEWIGFINPYNDGSKYNEKFKGKATLTSDKSSSTAYMELSSLTSEDSAVYYCTRDDGYYGYAMDYWGQGTSVTVSSGGGGSGGGGSGGGGSDIQMTQSPSSLSASLGERVSLTCRATQELSGYLSWLQQKPDGTIKRLIYAASTLDSGVPKRFSGNRSGSDYSLTISSLESEDFADYYCLQYAIYPYTFGGGTKLEIKREPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2105 - protein, 673 aa, Artificial Sequence
  source: /note="Description of Artificial Sequence: Synthetic Chimeric Antigen Receptor sequence"
MALPVTALLLPLALLLHAARPEVQLRQSGPELVKPGASVKMSCKASGYTFTSYFMHWVKQKPGQGLEWIGFINPYNDGTKYNEKFKGKATLTSDKSSSTAYMELNSLTSEDSAVYYCTRDDGYYDYAMDYWGQGTSVTVSSGGGGSGGGGSGGGGSDIQMTQSPSSLSASLGERVSLTCRASQEISVYLSWLQQKPDGTIKRLIYAASTLDSGVPERFSGSRSGSDYSLTISSLESEDFADYYCLQYASYPYTFGGGTKLEIKREPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2106 - protein, 673 aa, Artificial Sequence
  source: /note="Description of Artificial Sequence: Synthetic Chimeric Antigen Receptor sequence"
MALPVTALLLPLALLLHAARPQVQLQESGPGLVKPSETLSLTCVVSGGSISSSNWWSWVRQPPGKGLEWIGEIYHSGSPNYNPSLKSRVTISVDKSKNQFSLKLSSVTAADTAVYYCARQTTAGSFDYWGQGTLVTVSSGGGGSGGGGSGGGGSDIQMTQSPSSLSASVGDRVTITCRASQSISSYLNWYQQKPGKAPKLLIYAASSLQSGVPSRFSGSGSGTDFTLTISSLQPEDFATYYCQQSYSTPPTFGQGTKVEIKEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2107 - protein, 673 aa, Artificial Sequence
  source: /note="Description of Artificial Sequence: Synthetic Chimeric Antigen Receptor sequence"
MALPVTALLLPLALLLHAARPQVQLQESGPGLVKPSETLSLTCVVSGGSISSSNWWSWVRQPPGKGLEWIGEIYHSGSPNYNPSLKSRVTISVDKSKNQFSLKLSSVTAADTAVYYCARSSSGGFFDYWGQGTLVTVSSGGGGSGGGGSGGGGSDIQMTQSPSSLSASVGDRVTITCRASQSISSYLNWYQQKPGKAPKLLIYAASSLQSGVPSRFSGSGSGTDFTLTISSLQPEDFATYYCQQSYSTPPTFGQGTKVEIKEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2108 - protein, 674 aa, Artificial Sequence
  source: /note="Description of Artificial Sequence: Synthetic Chimeric Antigen Receptor sequence"
MALPVTALLLPLALLLHAARPEVQLQQSGPELVKPGASMKISCKASGYSFTGYTMNWVKQSHEKNLEWIGPINPYNDGTIYNPNFKGKATLTVDKASSTAYMELLSLTSDDPAVYYSCCARTDDYDDYTMDYWGQGTSVTVSSGGGGSGGGGSGGGGSEIQMTQTPSSLSASLGDRVTISCRASHDISNYLNWYQQKPDGTLKLLIYYTSRLHSGVPSRFSGSGSGTDYSLTISNLEQEDIATYFCQQGKTLLWTFGGGTKLEIKEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2109 - protein, 674 aa, Artificial Sequence
  source: /note="Description of Artificial Sequence: Synthetic Chimeric Antigen Receptor sequence"
MALPVTALLLPLALLLHAARPQVQLQQPGAELVKPGTSVKLSCKASGYTFTRYWMHWVKQRPGQGLEWIGMIHPSSGSTSYNEKVKNKATLTVDRSSTTAYMQLSSLTSEDSAVYYCARDGDYYYGTGDYWGQGTTLTVSSGGGGSGGGGSGGGGSQIVLSQSPAILSASPGEKVTMTCRASSSINYMHWYQQKPGSSPKPWIFATSNLASGVPSRFSGSGSGTSYSLTISRVEAEDAATYYCQQWRSDRALTFGAGTKLELEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2110 - protein, 675 aa, Artificial Sequence
  source: /note="Description of Artificial Sequence: Synthetic Chimeric Antigen Receptor sequence"
MALPVTALLLPLALLLHAARPDIQLQESGPGLVKPSQSLSLTCSVTGYSITSAYYWNWIRQFPGNKLEWMGYISYDGRNNYNPSLKNRISITRDTSKNQFFLKLNSVTTEDTATYYCAKEGDYDVGNYYAMDYWGQGTSVTVSSGGGGSGGGGSGGGGSENVLTQSPAIMSASPGEKVTMTCRASSNVISSYVHWYQQRSGASPKLWIYSTSNLASGVPARFSGSGSGTSYSLTISSVEAEDAATYYCQQYSGYPLTFGAGTKLELEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2111 - protein, 675 aa, Artificial Sequence
  source: /note="Description of Artificial Sequence: Synthetic Chimeric Antigen Receptor sequence"
MALPVTALLLPLALLLHAARPEVQLQQSGAELVRPGASVKLSCTASGFNIKDDYIHWVKQRPEQGLEWIGWIDPEKGDTAYASKFQDKATITSDTSSNTAYLQLSSLTSEDTAVYYCTLTGRFDYWGQGTTLTVSSGGGGSGGGGSGGGGSDIVMSQSPSSLAVSVGEKVTMSCKSSQSLLYSSNQKNNLAWYQQKPGQSPKLLIYWASTRESGVPDRFTGSGSGTDFTLTISSVQAEDLAVYYCQQYYSYRTFGGGTKLEIKEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2112 - protein, 675 aa, Artificial Sequence
  source: /note="Description of Artificial Sequence: Synthetic Chimeric Antigen Receptor sequence"
MALPVTALLLPLALLLHAARPEVQLQQSGPELVKPGASVKMSCKASGYIFTSYVMYWVKQKPGQGLEWIGYINPYNDGTKYNEKFKGKATLTSDKSSSTAYMELSSLTSEDSAVYYSCCARYYDYDYYFDYWGQGTTLTVSSGGGGSGGGGSGGGGSDIQMTQSPSSLSASLGGKVTITCKASQDINKYIAWYQHKPGKGPRLLIHYTSTLQPGIPSRFSGSGSGRDYSFSISNLEPEDIATYYCLQYDYLWTFGGGTKLEIKEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2113 - protein, 676 aa, Artificial Sequence
  source: /note="Description of Artificial Sequence: Synthetic Chimeric Antigen Receptor sequence"
MALPVTALLLPLALLLHAARPEVQLQQSGPELVKPGASVKMSCKASGYTFTSYFIHWVKQKPGQGLEWIGFINPYNDGSKYNEKFKGKATLTSDKSSSTAYMELSSLTSEDSAVYYCTRDDGYYGYAMDYWGQGTSVTVSSGGGGSGGGGSGGGGSDIQMTQSPSSLSASLGERVSLTCRATQELSGYLSWLQQKPDGTIKRLIYAASTLDSGVPKRFSGNRSGSDYSLTISSLESEDFADYYCLQYAIYPYTFGGGTKLEIKREPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2114 - protein, 676 aa, Artificial Sequence
  source: /note="Description of Artificial Sequence: Synthetic Chimeric Antigen Receptor sequence"
MALPVTALLLPLALLLHAARPEVQLRQSGPELVKPGASVKMSCKASGYTFTSYFMHWVKQKPGQGLEWIGFINPYNDGTKYNEKFKGKATLTSDKSSSTAYMELNSLTSEDSAVYYCTRDDGYYDYAMDYWGQGTSVTVSSGGGGSGGGGSGGGGSDIQMTQSPSSLSASLGERVSLTCRASQEISVYLSWLQQKPDGTIKRLIYAASTLDSGVPERFSGSRSGSDYSLTISSLESEDFADYYCLQYASYPYTFGGGTKLEIKREPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2115 - protein, 676 aa, Artificial Sequence
  source: /note="Description of Artificial Sequence: Synthetic Chimeric Antigen Receptor sequence"
MALPVTALLLPLALLLHAARPQVQLQQPGAELVKPGASMKMSCKASGYTFPSSNIHWLKQTPGQGLEWIGVIYPGNGDTSYNQKFKDKATLTTDKSSSTAYMQLSSLTSEDSAIYFSCCARVYNWHFDVWGAGTTVTVSSGGGGSGGGGSGGGGSNIVLTQSPASLAVSLGQRATISCRASESVDGYGDIFMLWYQQKPGQPPKLLIYFASNLESGVPARFSGSGSRTDFTLTIDPVEADDAATYYCQQNNEDPYTFGGGTKLEIKREPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2116 - protein, 677 aa, Artificial Sequence
  source: /note="Description of Artificial Sequence: Synthetic Chimeric Antigen Receptor sequence"
MALPVTALLLPLALLLHAARPEVQLQQSGPELVKPGASMKISCKASGYSFTGYTMNWVKQSHEKNLEWIGPINPYNDGTIYNPNFKGKATLTVDKASSTAYMELLSLTSDDPAVYYSCCARTDDYDDYTMDYWGQGTSVTVSSGGGGSGGGGSGGGGSEIQMTQTPSSLSASLGDRVTISCRASHDISNYLNWYQQKPDGTLKLLIYYTSRLHSGVPSRFSGSGSGTDYSLTISNLEQEDIATYFCQQGKTLLWTFGGGTKLEIKEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2117 - protein, 678 aa, Artificial Sequence
  source: /note="Description of Artificial Sequence: Synthetic Chimeric Antigen Receptor sequence"
MALPVTALLLPLALLLHAARPDIQLQESGPGLVKPSQSLSLTCSVTGYSITSAYYWNWIRQFPGNKLEWMGYISYDGRNNYNPSLKNRISITRDTSKNQFFLKLNSVTTEDTATYYCAKEGDYDVGNYYAMDYWGQGTSVTVSSGGGGSGGGGSGGGGSENVLTQSPAIMSASPGEKVTMTCRASSNVISSYVHWYQQRSGASPKLWIYSTSNLASGVPARFSGSGSGTSYSLTISSVEAEDAATYYCQQYSGYPLTFGAGTKLELEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2118 - protein, 678 aa, Artificial Sequence
  source: /note="Description of Artificial Sequence: Synthetic Chimeric Antigen Receptor sequence"
MALPVTALLLPLALLLHAARPEVQLQQSGPELVKPGASVKMSCKASGYTFTSYVMHWVKQKPGQGLEWIGYINPYNDGTKYNEKFKGKATLTSDTSSSTAYMELNSLTSEDSAVYFSCCARPIYFDNDYFDYWGQGTTLKVSSGGGGSGGGGSGGGGSTIVLTQSPASLAVSLGQRATISCRASESVDSYGNSFMHWYQQKPGQPPKLLIYLASNLESGVPARFSGSGSRTDFTLTIDPVEADDAATYYCQQNNYDPWTFGGGTKLEIKEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2119 - protein, 679 aa, Artificial Sequence
  source: /note="Description of Artificial Sequence: Synthetic Chimeric Antigen Receptor sequence"
MALPVTALLLPLALLLHAARPQVQLQQPGAELVKPGASMKMSCKASGYTFPSSNIHWLKQTPGQGLEWIGVIYPGNGDTSYNQKFKDKATLTTDKSSSTAYMQLSSLTSEDSAIYFSCCARVYNWHFDVWGAGTTVTVSSGGGGSGGGGSGGGGSNIVLTQSPASLAVSLGQRATISCRASESVDGYGDIFMLWYQQKPGQPPKLLIYFASNLESGVPARFSGSGSRTDFTLTIDPVEADDAATYYCQQNNEDPYTFGGGTKLEIKREPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2120 - protein, 679 aa, Artificial Sequence
  source: /note="Description of Artificial Sequence: Synthetic Chimeric Antigen Receptor sequence"
MALPVTALLLPLALLLHAARPQVQLQQPGAELVKPGASVKLSCKASGYTFTRYWMHWVKQRPGQGLEWIGNIDPSDTETHYNQQFKDKATLTVDKSSSTAYMQLSSLTSEDSAVYYCAIYYGNPSYYAMDYWGQGTSVTVSSGGGGSGGGGSGGGGSDIVMTQSPSSLTVTAGEKVTMSCKSSQNLLNSGNQKKYLNWYQQKPGQPPKLLIYWASTRESGVPDRFTGSGSGTDFTLTISSVQAEDLAVYFCQNDYSYPFTFGAGTKLELKEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2121 - protein, 681 aa, Artificial Sequence
  source: /note="Description of Artificial Sequence: Synthetic Chimeric Antigen Receptor sequence"
MALPVTALLLPLALLLHAARPEVQLQQSGPELVKPGASVKMSCKASGYTFTSYVMHWVKQKPGQGLEWIGYINPYNDGTKYNEKFKGKATLTSDTSSSTAYMELNSLTSEDSAVYFSCCARPIYFDNDYFDYWGQGTTLKVSSGGGGSGGGGSGGGGSTIVLTQSPASLAVSLGQRATISCRASESVDSYGNSFMHWYQQKPGQPPKLLIYLASNLESGVPARFSGSGSRTDFTLTIDPVEADDAATYYCQQNNYDPWTFGGGTKLEIKEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2122 - protein, 682 aa, Artificial Sequence
  source: /note="Description of Artificial Sequence: Synthetic Chimeric Antigen Receptor sequence"
MALPVTALLLPLALLLHAARPQVQLQQPGAELVKPGASVKLSCKASGYTFTRYWMHWVKQRPGQGLEWIGNIDPSDTETHYNQQFKDKATLTVDKSSSTAYMQLSSLTSEDSAVYYCAIYYGNPSYYAMDYWGQGTSVTVSSGGGGSGGGGSGGGGSDIVMTQSPSSLTVTAGEKVTMSCKSSQNLLNSGNQKKYLNWYQQKPGQPPKLLIYWASTRESGVPDRFTGSGSGTDFTLTISSVQAEDLAVYFCQNDYSYPFTFGAGTKLELKEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2123 - protein, 535 aa, Artificial Sequence
  source: /note="Description of Artificial Sequence: Synthetic Chimeric Antigen Receptor sequence"
MALPVTALLLPLALLLHAARPGSEIQLQQSGAELVKPGASVKLSCTGSGFNIEDYYIHWVKQRTEQGLEWIGRIDPENDETKYGPIFQGRATITADTSSNTVYLQLSSLTSEDTAVYYCAFRGGVYWGPGTTLTVSSGGGGSGGGGSGGGGSHMDVVMTQSPLTLSVAIGQSASISCKSSQSLLDSDGKTYLNWLLQRPGQSPKRLISLVSKLDSGVPDRFTGSGSGTDFTLRISRVEAEDLGIYYCWQGTHFPGTFGGGTKLEIKASTTTPAPRPPTPAPTIASQPLSLRPEACRPAAGGAVHTRGLDFACDFWVLVVVGGVLACYSLLVTVAFIIFWVRSKRSRLLHSDYMNMTPRRPGPTRKHYQPYAPPRDFAAYRSKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2124 - protein, 482 aa, Artificial Sequence
  source: /note="Description of Artificial Sequence: Synthetic Chimeric Antigen Receptor sequence"
MALPVTALLLPLALLLHAARPEVQLLESGGGLVQPGGSLRLSCAASGFTFSSYAMNWVRQAPGKGLEWVSAISDSGGSRWYADSVKGRFTISRDNSKNTLYLQMNSLRAEDTAVYYCTRYWPMDIWGQGTLVTVSSGGGGSGGGGSGGGGSEIVLTQSPGTLSLSPGERATLSCRASVRVSSTYLAWYQQKPGQAPRLLMYDASIRATGIPDRFSGSGSGTDFTLTISRLEPEDFAVYYCQQYMKWPLTFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2125 - protein, 668 aa, Artificial Sequence
  source: /note="Description of Artificial Sequence: Synthetic Chimeric Antigen Receptor sequence"
MALPVTALLLPLALLLHAARPEVQLLESGGGLVQPGGSLRLSCAASGFTFSSYAMNWVRQAPGKGLEWVSAISDSGGSRWYADSVKGRFTISRDNSKNTLYLQMNSLRAEDTAVYYCTRYWPMDIWGQGTLVTVSSGGGGSGGGGSGGGGSEIVLTQSPGTLSLSPGERATLSCRASVRVSSTYLAWYQQKPGQAPRLLMYDASIRATGIPDRFSGSGSGTDFTLTISRLEPEDFAVYYCQQYMKWPLTFGQGTKVEIKEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2126 - protein, 487 aa, Artificial Sequence
  source: /note="Description of Artificial Sequence: Synthetic Chimeric Antigen Receptor sequence"
MALPVTALLLPLALLLHAARPQVQLQQSGAELARPGASVKLSCKASGYTFTSYWMQWVKQRPGQGLEWIGAIYPGDGDTRYTQKFKGKATLTADKSSSTAYMQLSSLASEDSAVYYCARGKVYYGSNPFAYWGQGTLVTVSAGGGGSGGGGSGGGGSDIQMTQSSSYLSVSLGGRVTITCKASDHINNWLAWYQQKPGNAPRLLISGATSLETGVPSRFSGSGSGKDYTLSITSLQTEDVATYYCQQYWSTPWTFGGGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2127 - protein, 432 aa, Artificial Sequence
  source: /note="Description of Artificial Sequence: Synthetic Chimeric Antigen Receptor sequence"
MALPVTALLLPLALLLHAARPEVKLLESGGGLVQPGGSLKLSCAASGFDFSRYWMSWVRQAPGKGLEWIGEINPDSSTINYTPSLKDKFIISRDNAKNTLYLQMSKVRSEDTALYYCARPDGNYWYFDVWGAGTTVTVSSGGGGSGGGGSGGGGSDIVMTQSHKFMSTSVGDRVSITCKASQDVGIAVAWYQQKPGQSPKLLIYWASTRHTGVPDRFTGSGSGTDFTLTISNVQSEDLADYFCQQYSSYPYTFGGGTKLEIKGLAVSTISSFFPPGYQKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2128 - protein, 433 aa, Artificial Sequence
  source: /note="Description of Artificial Sequence: Synthetic Chimeric Antigen Receptor sequence"
MALPVTALLLPLALLLHAARPQVQLQQPGAELVRPGASVKLSCKASGYSFTTYWMNWVKQRPGQGLEWIGMIHPSDSETRLNQKFKDKATLTVDKSSSTAYMQLSSPTSEDSAVYYCARSTMIATRAMDYWGQGTSVTVSSGGGGSGGGGSGGGGSDIVMTQSQKSMSTSVGDRVSITCKASQDVITGVAWYQQKPGQSPKLLIYSASYRYTGVPDRFTGSGSGTDFTFTISNVQAEDLAVYYCQQHYSTPLTFGAGTKLELKGLAVSTISSFFPPGYQKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2129 - protein, 433 aa, Artificial Sequence
  source: /note="Description of Artificial Sequence: Synthetic Chimeric Antigen Receptor sequence"
MALPVTALLLPLALLLHAARPQVQLQQSGPELVKPGASVKISCKASGYAFSSSWMNWVKQRPGQGLEWIGRIYPGDGDTKYNGKFKGKATLTADKSSSTAYMQLSSLTSVDSAVYFCARSTMIATGAMDYWGQGTSVTVSSGGGGSGGGGSGGGGSETTVTQSPASLSMAIGEKVTIRCITSTDIDDDMNWYQQKPGEPPKLLISEGNTLRPGVPSRFSSSGYGTDFVFTIENMLSEDVADYYCLQSDNLPLTFGGGTKLEIKGLAVSTISSFFPPGYQKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2130 - protein, 434 aa, Artificial Sequence
  source: /note="Description of Artificial Sequence: Synthetic Chimeric Antigen Receptor sequence"
MALPVTALLLPLALLLHAARPQVQLQQSGAELARPGASVKLSCKASGYTFTSYWMQWVKQRPGQGLEWIGAIYPGDGDTRYTQKFKGKATLTADKSSSTAYMQLSSLASEDSAVYYCARGKVYYGSNPFAYWGQGTLVTVSAGGGGSGGGGSGGGGSDIQMTQSSSYLSVSLGGRVTITCKASDHINNWLAWYQQKPGNAPRLLISGATSLETGVPSRFSGSGSGKDYTLSITSLQTEDVATYYCQQYWSTPWTFGGGTKLEIKGLAVSTISSFFPPGYQKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2131 - protein, 434 aa, Artificial Sequence
  source: /note="Description of Artificial Sequence: Synthetic Chimeric Antigen Receptor sequence"
MALPVTALLLPLALLLHAARPQVQLQQSGPELVKPGASVKISCKASGYAFSSSWMNWVKQRPGQGLEWIGRIYPGDGDTKYNGKFKGKATLTADKSSSTAYMQLSSLTSVDSAVYFCARSTMIATGAMDYWGQGTSVTVSSGGGGSGGGGSGGGGSDIVMTQSHKFMSTSVGDRVSITCKASQDVSTAVAWYQQKPGQSPKLLIYSASYRYTGVPDRFTGSGSGTDFTFTISSVQAEDLAVYYCQQHYSTPPYTFGGGTKLEIKGLAVSTISSFFPPGYQKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2132 - protein, 459 aa, Artificial Sequence
  source: /note="Description of Artificial Sequence: Synthetic Chimeric Antigen Receptor sequence"
MGWSSIILFLVATATGVHSQVQLQQPGAELVRPGASVKLSCKASGYSFTTYWMNWVKQRPGQGLEWIGMIHPSDSETRLNQKFKDKATLTVDKSSSTAYMQLSSPTSEDSAVYYCARSTMIATRAMDYWGQGTSVTVSGGGGSGGGGSGGGGSDIVMTQSQKSMSTSVGDRVSITCKASQDVITGVAWYQQKPGQSPKLLIYSASYRYTGVPDRFTGSGSGTDFTFTISNVQAEDLAVYYCQQHYSTPLTFGAGTKLELKLEPKSCDKTHTCPPCPDPKFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2133 - protein, 485 aa, Artificial Sequence
  source: /note="Description of Artificial Sequence: Synthetic Chimeric Antigen Receptor sequence"
MALPVTALLLPLALLLHAARPEVKLLESGGGLVQPGGSLKLSCAASGFDFSRYWMSWVRQAPGKGLEWIGEINPDSSTINYTPSLKDKFIISRDNAKNTLYLQMSKVRSEDTALYYCARPDGNYWYFDVWGAGTTVTVSSGGGGSGGGGSGGGGSDIVMTQSHKFMSTSVGDRVSITCKASQDVGIAVAWYQQKPGQSPKLLIYWASTRHTGVPDRFTGSGSGTDFTLTISNVQSEDLADYFCQQYSSYPYTFGGGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2134 - protein, 486 aa, Artificial Sequence
  source: /note="Description of Artificial Sequence: Synthetic Chimeric Antigen Receptor sequence"
MALPVTALLLPLALLLHAARPQVQLQQPGAELVRPGASVKLSCKASGYSFTTYWMNWVKQRPGQGLEWIGMIHPSDSETRLNQKFKDKATLTVDKSSSTAYMQLSSPTSEDSAVYYCARSTMIATRAMDYWGQGTSVTVSSGGGGSGGGGSGGGGSDIVMTQSQKSMSTSVGDRVSITCKASQDVITGVAWYQQKPGQSPKLLIYSASYRYTGVPDRFTGSGSGTDFTFTISNVQAEDLAVYYCQQHYSTPLTFGAGTKLELKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2135 - protein, 487 aa, Artificial Sequence
  source: /note="Description of Artificial Sequence: Synthetic Chimeric Antigen Receptor sequence"
MALPVTALLLPLALLLHAARPQVQLQQSGPELVKPGASVKISCKASGYAFSSSWMNWVKQRPGQGLEWIGRIYPGDGDTKYNGKFKGKATLTADKSSSTAYMQLSSLTSVDSAVYFCARSTMIATGAMDYWGQGTSVTVSSGGGGSGGGGSGGGGSDIVMTQSHKFMSTSVGDRVSITCKASQDVSTAVAWYQQKPGQSPKLLIYSASYRYTGVPDRFTGSGSGTDFTFTISSVQAEDLAVYYCQQHYSTPPYTFGGGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2136 - protein, 488 aa, Artificial Sequence
  source: /note="Description of Artificial Sequence: Synthetic Chimeric Antigen Receptor sequence"
MALPVTALLLPLALLLHAARPGSDIQMTQSPSSLSASVGDRVTITCRASQGIRNNLAWYQQKPGKAPKRLIYAASNLQSGVPSRFTGSGSGTEFTLIVSSLQPEDFATYYCLQHHSYPLTSGGGTKVEIKRTGSTSGSGKPGSGEGSEVQVLESGGGLVQPGGSLRLSCAASGFTFSSYAMSWVRQAPGKGLEWVSAISGSGGSTNYADSVKGRFTISRDNSKNTLYLQMNSLRAEDTAVYYCAGSSGWSEYWGQGTLVTVSSASTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2137 - protein, 647 aa, Artificial Sequence
  source: /note="Description of Artificial Sequence: Synthetic Chimeric Antigen Receptor sequence"
MALPVTALLLPLALLLHAARPEVKLLESGGGLVQPGGSLKLSCAASGFDFSRYWMSWVRQAPGKGLEWIGEINPDSSTINYTPSLKDKFIISRDNAKNTLYLQMSKVRSEDTALYYCARPDGNYWYFDVWGAGTTVTVSSGGGGSGGGGSGGGGSDIVMTQSHKFMSTSVGDRVSITCKASQDVGIAVAWYQQKPGQSPKLLIYWASTRHTGVPDRFTGSGSGTDFTLTISNVQSEDLADYFCQQYSSYPYTFGGGTKLEIKEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2138 - protein, 648 aa, Artificial Sequence
  source: /note="Description of Artificial Sequence: Synthetic Chimeric Antigen Receptor sequence"
MALPVTALLLPLALLLHAARPQVQLQQPGAELVRPGASVKLSCKASGYSFTTYWMNWVKQRPGQGLEWIGMIHPSDSETRLNQKFKDKATLTVDKSSSTAYMQLSSPTSEDSAVYYCARSTMIATRAMDYWGQGTSVTVSSGGGGSGGGGSGGGGSDIVMTQSQKSMSTSVGDRVSITCKASQDVITGVAWYQQKPGQSPKLLIYSASYRYTGVPDRFTGSGSGTDFTFTISNVQAEDLAVYYCQQHYSTPLTFGAGTKLELKEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2139 - protein, 648 aa, Artificial Sequence
  source: /note="Description of Artificial Sequence: Synthetic Chimeric Antigen Receptor sequence"
MALPVTALLLPLALLLHAARPQVQLQQSGPELVKPGASVKISCKASGYAFSSSWMNWVKQRPGQGLEWIGRIYPGDGDTKYNGKFKGKATLTADKSSSTAYMQLSSLTSVDSAVYFCARSTMIATGAMDYWGQGTSVTVSSGGGGSGGGGSGGGGSETTVTQSPASLSMAIGEKVTIRCITSTDIDDDMNWYQQKPGEPPKLLISEGNTLRPGVPSRFSSSGYGTDFVFTIENMLSEDVADYYCLQSDNLPLTFGGGTKLEIKEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2140 - protein, 649 aa, Artificial Sequence
  source: /note="Description of Artificial Sequence: Synthetic Chimeric Antigen Receptor sequence"
MALPVTALLLPLALLLHAARPQVQLQQSGAELARPGASVKLSCKASGYTFTSYWMQWVKQRPGQGLEWIGAIYPGDGDTRYTQKFKGKATLTADKSSSTAYMQLSSLASEDSAVYYCARGKVYYGSNPFAYWGQGTLVTVSAGGGGSGGGGSGGGGSDIQMTQSSSYLSVSLGGRVTITCKASDHINNWLAWYQQKPGNAPRLLISGATSLETGVPSRFSGSGSGKDYTLSITSLQTEDVATYYCQQYWSTPWTFGGGTKLEIKEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2141 - protein, 649 aa, Artificial Sequence
  source: /note="Description of Artificial Sequence: Synthetic Chimeric Antigen Receptor sequence"
MALPVTALLLPLALLLHAARPQVQLQQSGPELVKPGASVKISCKASGYAFSSSWMNWVKQRPGQGLEWIGRIYPGDGDTKYNGKFKGKATLTADKSSSTAYMQLSSLTSVDSAVYFCARSTMIATGAMDYWGQGTSVTVSSGGGGSGGGGSGGGGSDIVMTQSHKFMSTSVGDRVSITCKASQDVSTAVAWYQQKPGQSPKLLIYSASYRYTGVPDRFTGSGSGTDFTFTISSVQAEDLAVYYCQQHYSTPPYTFGGGTKLEIKEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2142 - protein, 271 aa, Artificial Sequence
  source: /note="Description of Artificial Sequence: Synthetic polypeptide"
MALPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSHHHHHHHH

SEQ ID NO: 2143 - protein, 719 aa, Artificial Sequence
  source: /note="Description of Artificial Sequence: Synthetic Chimeric Antigen Receptor sequence"
ADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRRAEGRGSLLTCGDVEENPGPMAVPTQVLGLLLLWLTDARCDIQMTQSPSSLSASVGDRVTITCRASEDIYFNLVWYQQKPGKAPKLLIYDTNRLADGVPSRFSGSGSGTQYTLTISSLQPEDFATYYCQHYKNYPLTFGQGTKLEIKRSGGGGSGGGGSGGGGSRSEVQLVESGGGLVQPGGSLRLSCAASGFTLSNYGMHWIRQAPGKGLEWVSSISLNGGSTYYRDSVKGRFTISRDNAKSTLYLQMNSLRAEDTAVYYCAAQDAYTGGYFDYWGQGTLVTVSSMPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKMALIVLGGVAGLLLFIGLGIFFMALIVLGGVAGLLLFIGLGIFFCVRCRHRRRSGGGGSSHIQIPPGLTELLQGYTVEVLRQQPPDLVEFAVEYFTRLREARA

SEQ ID NO: 2144 - protein, 671 aa, Artificial Sequence
  source: /note="Description of Artificial Sequence: Synthetic Chimeric Antigen Receptor sequence"
MLTSLLCWMALCLLGADHADACPYSNPSLCSGGGGSELPTQGTFSNVSTNVSPAKPTTTACPYSNPSLCSGGGGSPAPRPPTPAPTIASQPLSLRPEACRPAAGGAVHTRGLDFACDIYIWAPLAGTCGVLLLSLVITLYCNHRNRRRVCKCPRPVVRAEGRGSLLTCGDVEENPGPMETDTLLLWVLLLWVPGSTGDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITKAGGGGSGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSDPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2145 - protein, 461 aa, Artificial Sequence
  source: /note="Description of Artificial Sequence: Synthetic Chimeric Antigen Receptor sequence"
EVQVLESGGGLVQPGGSLRLSCAASGFTFSSYAMSWVRQAPGKGLEWVSAISGSGGSTNYADSVKGRFTISRDNSKNTLYLQMNSLRAEDTAVYYCAGSSGWSEYWGQGTLVTVSSGGGGSGGGGSGGGGSDIQMTQSPSSLSASVGDRVTITCRASQGIRNNLAWYQQKPGKAPKRLIYAASNLQSGVPSRFTGSGSGTEFTLIVSSLQPEDFATYYCLQHHSYPLTSGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2146 - protein, 554 aa, Artificial Sequence
  source: /note="Description of Artificial Sequence: Synthetic Chimeric Antigen Receptor sequence"
MKHLWFFLLLVAAPRWVLSQVQLQESGPGLVKPSETLSLTCTVSGGSISSSSYYWGWIRQPPGKGLEWIGSIYYSGSTYYNPSLKSRVTISVDTSKNQFSLKLSSVTAADTAVYYCARLPMVTMSFDYWGQGTLVTVSRGGGGSGGGGSGGGGSMASYVLTQPPSVSVAPGKTARITCGGNNIGSKSVHWYQQKPGQAPVLVIYYDSDRPSGIPERFSGSNSGNTATLTISRVEAGDEADYYCQVWDSSSDHVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECSTRFWVLVVVGGVLACYSLLVTVAFIIFWVRSKRSRLLHSDYMNMTPRRPGPTRKHYQPYAPPRDFAAYRSLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPR

SEQ ID NO: 2147 - protein, 563 aa, Artificial Sequence
  source: /note="Description of Artificial Sequence: Synthetic Chimeric Antigen Receptor sequence"
MKHLWFFLLLVAAPRWVLSQVQLQESGPGLVKPSETLSLTCTVSGGSISSSSYYWGWIRQPPGKGLEWIGSIYYSGSTYYNPSLKSRVTISVDTSKNQFSLKLSSVTAADTAVYYCARLPMVTMSFDYWGQGTLVTVSRGGGGSGGGGSGGGGSMASYVLTQPPSVSVAPGKTARITCGGNNIGSKSVHWYQQKPGQAPVLVIYYDSDRPSGIPERFSGSNSGNTATLTISRVEAGDEADYYCQVWDSSSDHVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECSTRFWVLVVVGGVLACYSLLVTVAFIIFWVRLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRRSQCMWPRETQLLLEVPPSTEDARSCQFPEEERGERSAEEKGRLGDLWV

SEQ ID NO: 2148 - protein, 603 aa, Artificial Sequence
  source: /note="Description of Artificial Sequence: Synthetic Chimeric Antigen Receptor sequence"
MKHLWFFLLLVAAPRWVLSQVQLQESGPGLVKPSETLSLTCTVSGGSISSSSYYWGWIRQPPGKGLEWIGSIYYSGSTYYNPSLKSRVTISVDTSKNQFSLKLSSVTAADTAVYYCARLPMVTMSFDYWGQGTLVTVSRGGGGSGGGGSGGGGSMASYVLTQPPSVSVAPGKTARITCGGNNIGSKSVHWYQQKPGQAPVLVIYYDSDRPSGIPERFSGSNSGNTATLTISRVEAGDEADYYCQVWDSSSDHVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECSTRFWVLVVVGGVLACYSLLVTVAFIIFWVRSKRSRLLHSDYMNMTPRRPGPTRKHYQPYAPPRDFAAYRSLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRRSQCMWPRETQLLLEVPPSTEDARSCQFPEEERGERSAEEKGRLGDLWV

SEQ ID NO: 2149 - protein, 603 aa, Artificial Sequence [sequence omitted]

SEQ ID NO: 2150 - protein, 603 aa, Artificial Sequence [sequence omitted]

SEQ ID NO: 2151 - protein, 484 aa, Artificial Sequence
  source: /note="Description of Artificial Sequence: Synthetic Chimeric Antigen Receptor sequence"
MALPVTALLLPLALLLHAARPDIQMTQSPSSLSASVGDRVTITCRASQGIRNNLAWYQQKPGKAPKRLIYAASNLQSGVPSRFTGSGSGTEFTLIVSSLQPEDFATYYCLQHHSYPLTSGGGTKVEIKRTGSTSGSGKPGSGEGSEVQVLESGGGLVQPGGSLRLSCAASGFTFSSYAMSWVRQAPGKGLEWVSAISGSGGSTNYADSVKGRFTISRDNSKNTLYLQMNSLRAEDTAVYYCAGSSGWSEYWGQGTLVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2152 - protein, 491 aa, Artificial Sequence
  source: /note="Description of Artificial Sequence: Synthetic Chimeric Antigen Receptor sequence"
MALPVTALLLPLALLLHAARPGSEIQLQQSGAELVKPGASVKLSCTGSGFNIEDYYIHWVKQRTEQGLEWIGRIDPENDETKYGPIFQGRATITADTSSNTVYLQLSSLTSEDTAVYYCAFRGGVYWGPGTTLTVSSGGGGSGGGGSGGGGSHMDVVMTQSPLTLSVAIGQSASISCKSSQSLLDSDGKTYLNWLLQRPGQSPKRLISLVSKLDSGVPDRFTGSGSGTDFTLRISRVEAEDLGIYYCWQGTHFPGTFGGGTKLEIKASTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2153 - protein, 490 aa, Artificial Sequence
  source: /note="Description of Artificial Sequence: Synthetic Chimeric Antigen Receptor sequence"
MALPVTALLLPLALLLHAARPDVVMTQSPDSLAVSLGERATINCKSSQSLLDSDGKTYLNWLQQKPGQPPKRLISLVSKLDSGVPDRFSGSGSGTDFTLTISSLQAEDVAVYYCWQGTHFPGTFGGGTKVEIKGGGGSGGGGSGGGGSGGGGSEIQLVQSGAEVKKPGATVKISCKGSGFNIEDYYIHWVQQAPGKGLEWMGRIDPENDETKYGPIFQGRVTITADTSTNTVYMELSSLRSEDTAVYYCAFRGGVYWGQGTTVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2154 - protein, 490 aa, Artificial Sequence
  source: /note="Description of Artificial Sequence: Synthetic Chimeric Antigen Receptor sequence"
MALPVTALLLPLALLLHAARPEIQLVQSGAEVKKPGESLRISCKGSGFNIEDYYIHWVRQMPGKGLEWMGRIDPENDETKYGPIFQGHVTISADTSINTVYLQWSSLKASDTAMYYCAFRGGVYWGQGTTVTVSSGGGGSGGGGSGGGGSGGGGSDVVMTQSPLSLPVTLGQPASISCKSSQSLLDSDGKTYLNWLQQRPGQSPRRLISLVSKLDSGVPDRFSGSGSGTDFTLKISRVEAEDVGVYYCWQGTHFPGTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2155 - protein, 490 aa, Artificial Sequence
  source: /note="Description of Artificial Sequence: Synthetic Chimeric Antigen Receptor sequence"
MALPVTALLLPLALLLHAARPDVVMTQSPLSLPVTLGQPASISCKSSQSLLDSDGKTYLNWLQQRPGQSPRRLISLVSKLDSGVPDRFSGSGSGTDFTLKISRVEAEDVGVYYCWQGTHFPGTFGGGTKVEIKGGGGSGGGGSGGGGSGGGGSEIQLVQSGAEVKKPGESLRISCKGSGFNIEDYYIHWVRQMPGKGLEWMGRIDPENDETKYGPIFQGHVTISADTSINTVYLQWSSLKASDTAMYYCAFRGGVYWGQGTTVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2156 - protein, 490 aa, Artificial Sequence
  source: /note="Description of Artificial Sequence: Synthetic Chimeric Antigen Receptor sequence"
MALPVTALLLPLALLLHAARPEIQLVQSGAEVKKPGATVKISCKGSGFNIEDYYIHWVQQAPGKGLEWMGRIDPENDETKYGPIFQGRVTITADTSTNTVYMELSSLRSEDTAVYYCAFRGGVYWGQGTTVTVSSGGGGSGGGGSGGGGSGGGGSDVVMTQSPLSLPVTLGQPASISCKSSQSLLDSDGKTYLNWLQQRPGQSPRRLISLVSKLDSGVPDRFSGSGSGTDFTLKISRVEAEDVGVYYCWQGTHFPGTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2157 - protein, 490 aa, Artificial Sequence
  source: /note="Description of Artificial Sequence: Synthetic Chimeric Antigen Receptor sequence"
MALPVTALLLPLALLLHAARPEIQLVQSGAEVKKPGESLRISCKGSGFNIEDYYIHWVRQMPGKGLEWMGRIDPENDETKYGPIFQGHVTISADTSINTVYLQWSSLKASDTAMYYCAFRGGVYWGQGTTVTVSSGGGGSGGGGSGGGGSGGGGSDVVMTQSPDSLAVSLGERATINCKSSQSLLDSDGKTYLNWLQQKPGQPPKRLISLVSKLDSGVPDRFSGSGSGTDFTLTISSLQAEDVAVYYCWQGTHFPGTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2158 - protein, 490 aa, Artificial Sequence
  source: /note="Description of Artificial Sequence: Synthetic Chimeric Antigen Receptor sequence"
MALPVTALLLPLALLLHAARPDVVMTQSPDSLAVSLGERATINCKSSQSLLDSDGKTYLNWLQQKPGQPPKRLISLVSKLDSGVPDRFSGSGSGTDFTLTISSLQAEDVAVYYCWQGTHFPGTFGGGTKVEIKGGGGSGGGGSGGGGSGGGGSEIQLVQSGAEVKKPGESLRISCKGSGFNIEDYYIHWVRQMPGKGLEWMGRIDPENDETKYGPIFQGHVTISADTSINTVYLQWSSLKASDTAMYYCAFRGGVYWGQGTTVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2159 - protein, 490 aa, Artificial Sequence
  source: /note="Description of Artificial Sequence: Synthetic Chimeric Antigen Receptor sequence"
MALPVTALLLPLALLLHAARPDVVMTQSPLSLPVTLGQPASISCKSSQSLLDSDGKTYLNWLQQRPGQSPRRLISLVSKLDSGVPDRFSGSGSGTDFTLKISRVEAEDVGVYYCWQGTHFPGTFGGGTKVEIKGGGGSGGGGSGGGGSGGGGSEIQLVQSGAEVKKPGATVKISCKGSGFNIEDYYIHWVQQAPGKGLEWMGRIDPENDETKYGPIFQGRVTITADTSTNTVYMELSSLRSEDTAVYYCAFRGGVYWGQGTTVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2160 - protein, 487 aa, Artificial Sequence
  source: /note="Description of Artificial Sequence: Synthetic Chimeric Antigen Receptor sequence"
MALPVTALLLPLALLLHAARPEIQLQQSGAELVKPGASVKLSCTGSGFNIEDYYIHWVKQRTEQGLEWIGRIDPENDETKYGPIFQGRATITADTSSNTVYLQLSSLTSEDTAVYYCAFRGGVYWGPGTTLTVSSGGGGSGGGGSGGGGSHMDVVMTQSPLTLSVAIGQSASISCKSSQSLLDSDGKTYLNWLLQRPGQSPKRLISLVSKLDSGVPDRFTGSGSGTDFTLRISRVEAEDLGIYYCWQGTHFPGTFGGGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2161 - protein, 490 aa, Artificial Sequence
  source: /note="Description of Artificial Sequence: Synthetic Chimeric Antigen Receptor sequence"
MALPVTALLLPLALLLHAARPEIQLVQSGAEVKKPGATVKISCKGSGFNIEDYYIHWVQQAPGKGLEWMGRIDPENDETKYGPIFQGRVTITADTSTNTVYMELSSLRSEDTAVYYCAFRGGVYWGQGTTVTVSSGGGGSGGGGSGGGGSGGGGSDVVMTQSPDSLAVSLGERATINCKSSQSLLDSDGKTYLNWLQQKPGQPPKRLISLVSKLDSGVPDRFSGSGSGTDFTLTISSLQAEDVAVYYCWQGTHFPGTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2162 - protein, 439 aa, Artificial Sequence
  source: /note="Description of Artificial Sequence: Synthetic Chimeric Antigen Receptor sequence"
MALPVTALLLPLALLLHAARPDIQMTQSPSSLSASVGDRVTITCRASQGIRNNLAWYQQKPGKAPKRLIYAASNLQSGVPSRFTGSGSGTEFTLIVSSLQPEDFATYYCLQHHSYPLTSGGGTKVEIKRTGSTSGSGKPGSGEGSEVQVLESGGGLVQPGGSLRLSCAASGFTFSSYAMSWVRQAPGKGLEWVSAISGSGGSTNYADSVKGRFTISRDNSKNTLYLQMNSLRAEDTAVYYCAGSSGWSEYWGQGTLVTVSSTTTPAPRPPTPAPTIASQPLSLRPEACRPAAGGAVHTRGLDFACDIYIWAPLAGTCGVLLLSLVITLYCKRGRKKLLGGGGSGGGGSKRDHHHHHHQDKKTMMMNEEDDGNGMDELLAVLGYKVRSSEMADVAQKLEQLEVMMSNVQEDDLSQLATETVHYNPAELYTWLDSMLTDLN

SEQ ID NO: 2163 - protein, 446 aa, Artificial Sequence
  source: /note="Description of Artificial Sequence: Synthetic Chimeric Antigen Receptor sequence"
MALPVTALLLPLALLLHAARPDIQMTQSPSSLSASVGDRVTITCRASQGIRNNLAWYQQKPGKAPKRLIYAASNLQSGVPSRFTGSGSGTEFTLIVSSLQPEDFATYYCLQHHSYPLTSGGGTKVEIKRTGSTSGSGKPGSGEGSEVQVLESGGGLVQPGGSLRLSCAASGFTFSSYAMSWVRQAPGKGLEWVSAISGSGGSTNVADSVKGRFTISRDNSKNTLVLQMNSLRAEDTAVYYCAGSSGWSEYWGQGTLVTVSSKRGRKKLLGGGGSGGGGSASRILWHEMWHEGLEEASRLYFGERNVKGMFEVLEPLHAMMERGPQTLKETSFNQAYGRDLMEAQEWCRKYMKSGNVKDLLQAWDLYYHVFRRISKTSTTTPAPRPPTPAPTIASQPLSLRPEACRPAAGGAVHTRGLDFACDIYIWAPLAGTCGVLLLSLVITLYC

SEQ ID NO: 2164 - protein, 446 aa, Artificial Sequence
  source: /note="Description of Artificial Sequence: Synthetic Chimeric Antigen Receptor sequence"
MALPVTALLLPLALLLHAARPDIQMTQSPSSLSASVGDRVTITCRASQGIRNNLAWYQQKPGKAPKRLIYAASNLQSGVPSRFTGSGSGTEFTLIVSSLQPEDFATYYCLQHHSYPLTSGGGTKVEIKRTGSTSGSGKPGSGEGSEVQVLESGGGLVQPGGSLRLSCAASGFTFSSYAMSWVRQAPGKGLEWVSAISGSGGSTNYADSVKGRFTISRDNSKNTLYLQMNSLRAEDTAVYYCAGSSGWSEYWGQGTLVTVSSTTTPAPRPPTPAPTIASQPLSLRPEACRPAAGGAVHTRGLDFACDIYIWAPLAGTCGVLLLSLVITLYCKRGRKKLLGGGGSGGGGSASRILWHEMWHEGLEEASRLYFGERNVKGMFEVLEPLHAMMERGPQTLKETSFNQAYGRDLMEAQEWCRKYMKSGNVKDLLQAWDLYYHVFRRISKTS

SEQ ID NO: 2165 - protein, 456 aa, Artificial Sequence
  source: /note="Description of Artificial Sequence: Synthetic Chimeric Antigen Receptor sequence"
MALPVTALLLPLALLLHAARPDIQMTQSPSSLSASVGDRVTITCRASQGIRNNLAWYQQKPGKAPKRLIYAASNLQSGVPSRFTGSGSGTEFTLIVSSLQPEDFATYYCLQHHSYPLTSGGGTKVEIKRTGSTSGSGKPGSGEGSEVQVLESGGGLVQPGGSLRLSCAASGFTFSSYAMSWVRQAPGKGLEWVSAISGSGGSTNYADSVKGRFTISRDNSKNTLYLQMNSLRAEDTAVYYCAGSSGWSEYWGQGTLVTVSSKRGRKKLLGGGGSGGGSGVQVETISPGDGRTFPKRGQTCVVHYTGMLEDGKKFDSSRDRNKPFKFMLGKQEVIRGWEEGVAQMSVGQRAKLTISPDYAYGATGHPGIIPPHATLVFDVELLKLETSTTTPAPRPPTPAPTIASQPLSLRPEACRPAAGGAVHTRGLDFACDIYIWAPLAGTCGVLLLSLVITLYC

SEQ ID NO: 2166 - protein, 457 aa, Artificial Sequence
  source: /note="Description of Artificial Sequence: Synthetic Chimeric Antigen Receptor sequence"
MALPVTALLLPLALLLHAARPDIQMTQSPSSLSASVGDRVTITCRASQGIRNNLAWYQQKPGKAPKRLIYAASNLQSGVPSRFTGSGSGTEFTLIVSSLQPEDFATYYCLQHHSYPLTSGGGTKVEIKRTGSTSGSGKPGSGEGSEVQVLESGGGLVQPGGSLRLSCAASGFTFSSYAMSWVRQAPGKGLEWVSAISGSGGSTNYADSVKGRFTISRDNSKNTLYLQMNSLRAEDTAVYYCAGSSGWSEYWGQGTLVTVSSTTTPAPRPPTPAPTIASQPLSLRPEACRPAAGGAVHTRGLDFACDIYIWAPLAGTCGVLLLSLVITLYCKRGRKKLLGGGGSGGGGSGVQVETISPGDGRTFPKRGQTCVVHYTGMLEDGKKFDSSRDRNKPFKFMLGKQEVIRGWEEGVAQMSVGQRAKLTISPDYAYGATGHPGIIPPHATLVFDVELLKLETS

SEQ ID NO: 2167 - protein, 464 aa, Artificial Sequence
  source: /note="Description of Artificial Sequence: Synthetic Chimeric Antigen Receptor sequence"
QVQLQQSGGGLVKPGASLKLSCVTSGFTFRKFGMSWVRQTSDKRLEWVASISTGGYNTYYSDNVKGRFTISRENAKNTLYLQMSSLKSEDTALYYCTRGYSSTSYAMDYWGQGTTVTVGGGGSGGGGSGGGGSDIELTQSPASLSVATGEKVTIRCMTSTDIDDDMNWYQQKPGEPPKFLISEGNTLRPGVPSRFSSSGTGTDFVFTIENTLSEDVGDYYCLQSFNVPLTFGDGTKLEKALTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2168 - protein, 482 aa, Artificial Sequence
  source: /note="Description of Artificial Sequence: Synthetic Chimeric Antigen Receptor sequence"
MALPVTALLLPLALLLHAARPDIQMTQSPSSLSASVGDRVTITCRASQGIRNNLAWYQQKPGKAPKRLIYAASNLQSGVPSRFTGSGSGTEFTLIVSSLQPEDFATYYCLQHHSYPLTSGGGTKVEIKGGGGSGGGGSGGGGSEVQVLESGGGLVQPGGSLRLSCAASGFTFSSYAMSWVRQAPGKGLEWVSAISGSGGSTNYADSVKGRFTISRDNSKNTLYLQMNSLRAEDTAVYYCAGSSGWSEYWGQGTLVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2169 - protein, 484 aa, Artificial Sequence
  source: /note="Description of Artificial Sequence: Synthetic Chimeric Antigen Receptor sequence"
MVLLVTSLLLCELPHPAFLLIPDIQMTQSPSSLSASVGDRVTITCRASQGIRNNLAWYQQKPGKAPKRLIYAASNLQSGVPSRFTGSGSGTEFTLIVSSLQPEDFATYYCLQHHSYPLTSGGGTKVEIKRTGSTSGSGKPGSGEGSEVQVLESGGGLVQPGGSLRLSCAASGFTFSSYAMSWVRQAPGKGLEWVSAISGSGGSTNYADSVKGRFTISRDNSKNTLYLQMNSLRAEDTAVYYCAGSSGWSEYWGQGTLVTVSSAAAIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2170 - protein, 485 aa, Artificial Sequence
  source: /note="Description of Artificial Sequence: Synthetic Chimeric Antigen Receptor sequence"
MALPVTALLLPLALLLHAARPQVQLQQSGGGLVKPGASLKLSCVTSGFTFRKFGMSWVRQTSDKRLEWVASISTGGYNTYYSDNVKGRFTISRENAKNTLYLQMSSLKSEDTALYYCTRGYSSTSYAMDYWGQGTTVTVGGGGSGGGGSGGGGSDIELTQSPASLSVATGEKVTIRCMTSTDIDDDMNWYQQKPGEPPKFLISEGNTLRPGVPSRFSSSGTGTDFVFTIENTLSEDVGDYYCLQSFNVPLTFGDGTKLEKALTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2171 - protein, 548 aa, Artificial Sequence
  source: /note="Description of Artificial Sequence: Synthetic Chimeric Antigen Receptor sequence"
MVLLVTSLLLCELPHPAFLLIPDIQMTQSPSSLSASVGDRVTITCRASQGIRNNLAWYQQKPGKAPKRLIYAASNLQSGVPSRFTGSGSGTEFTLIVSSLQPEDFATYYCLQHHSYPLTSGGGTKVEIKRTGSTSGSGKPGSGEGSEVQVLESGGGLVQPGGSLRLSCAASGFTFSSYAMSWVRQAPGKGLEWVSAISGSGGSTNYADSVKGRFTISRDNSKNTLYLQMNSLRAEDTAVYYCAGSSGWSEYWGQGTLVTVSSAAAFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2172 - protein, 567 aa, Artificial Sequence
  source: /note="Description of Artificial Sequence: Synthetic Chimeric Antigen Receptor sequence"
MALPVTALLLPLALLLHAARPDIQMTQSPSSLSASVGDRVTITCRASQGIRNNLAWYQQKPGKAPKRLIYAASNLQSGVPSRFTGSGSGTEFTLIVSSLQPEDFATYYCLQHHSYPLTSGGGTKVEIKRTGSTSGSGKPGSGEGSEVQVLESGGGLVQPGGSLRLSCAASGFTFSSYAMSWVRQAPGKGLEWVSAISGSGGSTNYADSVKGRFTISRDNSKNTLYLQMNSLRAEDTAVYYCAGSSGWSEYWGQGTLVRVSSTTTPAPRPPTPAPTIASQPLSLRPEACRPAAGGAVHTRGLDFACDIYIWAPLAGTCGVLLLSLVITLYCKRGRKKLLGGGGSGGGGSSNSYDSSSIKVLKGLDAVRKRPGMYIGDTDDGTGLHHMVFEVVDNAIDEALAGHCKEIIVTIHADNSVSVQDDGRGIPTGIHPEEGVSAAEVIMTVLHAGGKFDDNSYKVSGGLHGVGVSVVNALSQKLELVIQREGKIHRQIYEHGVPQAPLAVTGETEKTGTMVRFWPSLETFTNVTEFEYEILAKRLRELSFLNSGVSIRLRDKRDGKEDHFHYEG

SEQ ID NO: 2173 - protein, 647 aa, Artificial Sequence
  source: /note="Description of Artificial Sequence: Synthetic Chimeric Antigen Receptor sequence"
EVQVLESGGGLVQPGGSLRLSCAASGFTFSSYAMSWVRQAPGKGLEWVSAISGSGGSTNYADSVKGRFTISRDNSKNTLYLQMNSLRAEDTAVYYCAGSSGWSEYWGQGTLVTVSSGGGGSGGGGSGGGGSDIQMTQSPSSLSASVGDRVTITCRASQGIRNNLAWYQQKPGKAPKRLIYAASNLQSGVPSRFTGSGSGTEFTLIVSSLQPEDFATYYCLQHHSYPLTSGGGTKVEIKEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2174 - protein, 650 aa, Artificial Sequence
  source: /note="Description of Artificial Sequence: Synthetic Chimeric Antigen Receptor sequence"
QVQLQQSGGGLVKPGASLKLSCVTSGFTFRKFGMSWVRQTSDKRLEWVASISTGGYNTYYSDNVKGRFTISRENAKNTLYLQMSSLKSEDTALYYCTRGYSSTSYAMDYWGQGTTVTVGGGGSGGGGSGGGGSDIELTQSPASLSVATGEKVTIRCMTSTDIDDDMNWYQQKPGEPPKFLISEGNTLRPGVPSRFSSSGTGTDFVFTIENTLSEDVGDYYCLQSFNVPLTFGDGTKLEKALEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2175 - protein, 672 aa, Artificial Sequence [sequence omitted]

SEQ ID NO: 2176 - protein, 675 aa, Artificial Sequence [sequence omitted]

SEQ ID NO: 2177 - protein, 692 aa, Artificial Sequence
  source: /note="Description of Artificial Sequence: Synthetic Chimeric Antigen Receptor sequence"
MALPVTALLLPLALLLHAARPDIQMTQSPSSLSASVGDRVTITCRASQGIRNNLAWYQQKPGKAPKRLIYAASNLQSGVPSRFTGSGSGTEFTLIVSSLQPEDFATYYCLQHHSYPLTSGGGTKVEIKRTGSTSGSGKPGSGEGSEVQVLESGGGLVQPGGSLRLSCAASGFTFSSYAMSWVRQAPGKGLEWVSAISGSGGSTNYADSVKGRFTISRDNSKNTLYLQMNSLRAEDTAVYYCAGSSGWSEYWGQGTLVTVSSTTTPAPRPPTPAPTIASQPLSLRPEACRPAAGGAVHTRGLDFACDIYIWAPLAGTCGVLLLSLVITLYCKRGRKKLLGGGGSGGGGSAASDEVNLIESRTVVPLNTWVLISNFKVAYNILRRPDGTFNRHLAEYLDRKVTANANPVDGVFSFDVLIDRRINLLSRVYRPAYADQEQPPSILDLEKPVDGDIVPVILFFHGGSFAHSSANSAIYDTLCRRLVGLCKCVVVSVNYRRAPENPYPCAYDDGWIALNWVNSRSWLKSKKDSKVHIFLAGDSSGGNIAHNVALRAGESGIDVLGNILLNPMFGGNERTESEKSLDGKYFVTVRDRDWYWKAFLPEGEDREHPACNPFSPRGKSLEGVSFPKSLVVVAGLDLIRDWQLAYAEGLKKAGQEVKLMHLEKATVGFYLLPNNNHFHNVMDEISAFVNAEC

SEQ ID NO: 2178 - protein, 243 aa, Artificial Sequence; identical to SEQ ID NO: 559
  source: /note="Description of Artificial Sequence: Synthetic Chimeric Antigen Receptor sequence"

SEQ ID NO: 2179 - protein, 422 aa, Artificial Sequence
  source: /note="Description of Artificial Sequence: Synthetic Chimeric Antigen Receptor sequence"
MALPVTALLLPLALLLHAARPEIQLQQSGAELVKPGASVKLSCTGSGFNIEDYYIHWVKQRTEQGLEWIGRIDPENDETKYGPIFQGRATITADTSSNTVYLQLSSLTSEDTAVYYCAFRGGVYWGPGTTLTVSSGGGGSGGGGSGGGGSHMDVVMTQSPLTLSVAIGQSASISCKSSQSLLDSDGKTYLNWLLQRPGQSPKRLISLVSKLDSGVPDRFTGSGSGTDFTLRISRVEAEDLGIYYCWQGTHFPGTFGGGTKLEIQTLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2180 - protein, 490 aa, Artificial Sequence
  source: /note="Description of Artificial Sequence: Synthetic Chimeric Antigen Receptor sequence"
MALPVTALLLPLALLLHAARPEIQLVQSSAEVKKPSATVKISCKSSSFNIEDYYIHWVQQAPGKGLEWMGRIDPENDETKYGPIFQGRVTITADTSTNTVYMELSSLRSEDTAVYYCAFRGGVYWGQGTTVTVSSGGGGSGGGGSGGGGSGGGGSDVVMTQSPLSLPVTLGQPASISCKSSQSLLDSDGKTYLNWLQQRPGQSPRRLISLVSKLDSGVPDRFSGSGSGTDFTLKISRVEAEDVGVYYCWQGTHFPGTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2181 - protein, 491 aa, Artificial Sequence
  source: /note="Description of Artificial Sequence: Synthetic Chimeric Antigen Receptor sequence"
MALPVTALLLPLALLLHAARPDVVMTQSPLSLPVTLGQPASISCKSSCISLLDSDGKTYLNWLQQRPGQSPRRLISLVSKLDSGVPDRFSGSGSGTDFTLKISRVEAEDVGVYYCWQGTHFPGTFGGGTKVEIKGGGGSGGGGSGGGGSGGGGSEIQLVQSGAEVKKPGATVKISCKGSGFNIEDYYIHWVQQAPGKGLEWMGRIDPENDETKYGPIFQGRVTITADTSTNTVYMELSSLRSEDTAVYYCAFRGGVYWGQGTTVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2182 - protein, 240 aa, Artificial Sequence; identical to SEQ ID NO: 511
  source: /note="Description of Artificial Sequence: Synthetic Chimeric Antigen Receptor sequence"

SEQ ID NO: 2183 - protein, 1347 aa, Artificial Sequence
  source: /note="Description of Artificial Sequence: Synthetic Chimeric Antigen Receptor sequence"
QVQLVESGPGVVQPGRSLRISCAVSGFSVTNYGVHWVRQPPGKGLEWLGVRWAGGITNYNSAFMSRLTISKDNSKNTVYLQMNSLRAEDTAMYYCASRGGHYGYALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKGSTSGSGKPGSSEGSTKGEIVMTQTPATLSVSAGERVTITCKASQSVSNDVTWYQQKPGQAPRLLIYSASNRYSGVPARFSGSGYGTEFTFTISSVQSEDFAVYFCQQDYSSFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECGSTSGSGKPGSSEGSTKGFWVLVVVGGVLACYSLLVTVAFIIFWVKRGRKKLLYIFKQPFMRPVQTTQEEDGCSCRFPEEEEGGCELQRRKYRSNKGESPVEPAEPCHYSCPREEEGSTIPIQEDYRKPEPACSPGSTSGSGKPGSSEGSTKGRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSTSGSGKPGSSEGSTKGVGALESLRGNADLAYILSMEPCGHCLIINNVNFCRESGLRTRTGSNIDCEKLRRRFSSLHFMVEVKGDLTAKKMVLALLELAQQDHGALDCCVVVILSHGCQASHLQFPGAVYGTDGCPVSVEKIVNIFNGTSCPSLGGKPKLFFIQACGGEQKDHGFEVASTSPEDESPGSNPEPDATPFQEGLRTFDQLDAISSLPTPSDIFVSYSTFPGFVSWRDPKSGSWYVETLDDIFEQWAHSEDLQSLLLRVANAVSVKGIYKQMPGCFNFLRKKLFFKTSMGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 2184 - protein, 484 aa, Artificial Sequence; identical to SEQ ID NO: 2151
  source: /note="Description of Artificial Sequence: Synthetic polypeptide"

SEQ ID NO: 2185 - protein, 504 aa, Artificial Sequence
  source: /note="Description of Artificial Sequence: Synthetic Chimeric Antigen Receptor sequence"
MALPVTALLLPLALLLHAARPGSSRAAQPAMAQVQLQQSGAELVKPGASVKISCKASGYSFTGYFMNWVKQSHGKSLEWIGRIHPYDGDTFYNQNFKDKATLTVDKSSNTAHMELLSLTSEDFAVYYCTRYDGSRAMDYWGQGTTVTVSSGGGGSGGGGSGGGGSDIELTQSPASLAVSLGQRAIISCKASQSVSFAGTSLMHWYHQKPGQQPKLLIYRASNLEAGVPTRFSGSGSKTDFTLNIHPVEEEDAATYYCQQSREYPYTFGGGTKLEIKRAAASTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2186 - protein, 491 aa, Artificial Sequence
  source: /note="Description of Artificial Sequence: Synthetic Chimeric Antigen Receptor sequence"
MALPVTALLLPLALLLHAARPGSQLVESGGGLVQPGRSLRLSCTTSGFTFGDYAMIWARQAPGKGLEWVSSISSSSSYIYYADSVKGRFTISRDNAKNSLYLQMNSLRAEDTAVYYCARERYDFWSGMDVWGKGTTVTVSSGGGGSGGGGSGGSAQSALTQPASVSGSPGQSITISCTGTSSDVGSYNLVSWYQQHPGKAPKLMIYEGSKRPSGVSNRFSGSKSGNAASLTISGLQAEDEADYYCQSYDSSLSVVFGGGTKLTVLGASTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2187 - protein, 450 aa, Artificial Sequence
  source: /note="Description of Artificial Sequence: Synthetic Chimeric Antigen Receptor sequence"
MALPVTALLLPLALLLHAARPGSAEVQLVQSGAEVKKPGASVKVSCKASGYTFTSYAMHWVRQAPGQRLEWMGWINAGNGNTKYSQKFQGRVTITRDTSASTAYMELSSLRSEDTAVYYCARDISYGSFDYWGQGTLVTVSSGGGGSGGGGSGGGGSSSELTQDPAVSVALGQTVRITCQGDNLRSYYASWYRQKSGQAPVLVIYGKNNRPSGIPDRFSGSSSGNTASLTITAAQAEDEADYYCHSRKSRGNHLLFGGGTKLTVLGQASTTTPAPRPPTPAPTIASQPLSLRPEACRPAAGGAVHTRGLDFACDIYIWAPLAGTCGVLLLSLVITLYCRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2188 - protein, 450 aa, Artificial Sequence
  source: /note="Description of Artificial Sequence: Synthetic Chimeric Antigen Receptor sequence"
MALPVTALLLPLALLLHAARPGSAEVQLVQSGAEVKKPGASVKVSCKASGYTFTSYAMHWVRQAPGQRLEWMGWINAGNGNTKYSQKFQGRVTITRDTSASTAYMELSSLRSEDTAVYYCARDISYGSFDYWGQGTLVTVSSGGGGSGGGGSGGGGSSSELTQDPAVSVALGQTVRITCQGDSLRSNYANWYQQKPGQAPVLVIYGQNNRPSGIPDRFSGSSSGNTASLTITGAQAADEADYYCDSRVSTGNHVVFGGGTKLTVLGQASTTTPAPRPPTPAPTIASQPLSLRPEACRPAAGGAVHTRGLDFACDIYIWAPLAGTCGVLLLSLVITLYCRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2189 - protein, 466 aa, Artificial Sequence
  source: /note="Description of Artificial Sequence: Synthetic Chimeric Antigen Receptor sequence"
DAVVTQESALTSSPGETVTLTCRSSTGAVTISNVASWVQEKPDHLFTGLIGGTNNRAPGVPARFSGSLIGDKAALTITGAQTEDEAIYFCVLWYSDHWVFGGGTKLTVLGGGGGSGGGGSGGGGSGGGGSDVQLQESGPGLVAPSQSLSITCTVSGFLLTDVGVNWVRQSPGKGLEWLGVIWGDGITDYNSALKSRLSVTKDNSKSQVFLKMNSLQSGDSARVYCVTGLFDYWGQGTTLTVSSTTTPAPRPPTPAPTIASQPLSLRPEACRPAAGGAVHTRGLDFACDIYIWAPLAGTCGVLLLSLVITLVCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAVSEIGMKGERRRGKGHDGLYQGLSTATKDTYDALHMQALPPR

SEQ ID NO: 2190 - protein, 492 aa, Artificial Sequence
  source: /note="Description of Artificial Sequence: Synthetic Chimeric Antigen Receptor sequence"
MALPVTALLLPLALLLHAARPGSAEVQLVQSGAEVKKPGASVKVSCKASGYTFTSYAMHWVRQAPGQRLEWMGWINAGNGNTKYSQKFQGRVTITRDTSASTAYMELSSLRSEDTAVYYCARDISYGSFDYWGQGTLVTVSSGGGGSGGGGSGGGGSSSELTQDPAVSVALGQTVRITCQGDSLRSNYANWYQQKPGQAPVLVIYGQNNRPSGIPDRFSGSSSGNTASLTITGAQAADEADYYCDSRVSTGNHVVFGGGTKLTVLGQASTTTPAPRPPTPAPTIASQPLSLRPEACRPAAGGAVHTRGLDFACDIYIWAPLAGTCGVLLLSLVITLYCRVGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2191 - protein, 496 aa, Artificial Sequence
  source: /note="Description of Artificial Sequence: Synthetic Chimeric Antigen Receptor sequence"
MALPVTALLLPLALLLHAARPGSAEVQLVQSGAEVKKPGASVKVSCKASGYTFTSYAMHWVRQAPGQRLEWMGWINAGNGNTKYSQKFQGRVTITRDTSASTAYMELSSLRSEDTAVYYCARDISYGSFDYWGQGTLVTVSSGGGGSGGGGSGGGGSSSELTQDPAVSVALGQTVRITCQGDNLRSYYASWYRQKSGQAPVLVIYGKNNRPSGIPDRFSGSSSGNTASLTITAAQAEDEADYYCHSRKSRGNHLLFGGGTKLTVLGQASTTTPAPRPPTPAPTIASQPLSLRPEACRPAAGGAVHTRGLDFACDFWVLVVVGGVLACYSLLVTVAFIIFWVRSKRSRLLHSDYMNMTPRRPGPTRKHYQPYAPPRDFAAYRSIDRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2192 - protein, 496 aa, Artificial Sequence
  source: /note="Description of Artificial Sequence: Synthetic Chimeric Antigen Receptor sequence"
MALPVTALLLPLALLLHAARPGSAEVQLVQSGAEVKKPGASVKVSCKASGYTFTSYAMHWVRQAPGQRLEWMGWINAGNGNTKYSQKFQGRVTITRDTSASTAYMELSSLRSEDTAVYYCARDISYGSFDYWGQGTLVTVSSGGGGSGGGGSGGGGSSSELTQDPAVSVALGQTVRITCQGDSLRSNYANWYQQKPGQAPVLVIYGQNNRPSGIPDRFSGSSSGNTASLTITGAQAADEADYYCDSRVSTGNHVVFGGGTKLTVLGQASTTTPAPRPPTPAPTIASQPLSLRPEACRPAAGGAVHTRGLDFACDFWVLVVVGGVLACYSLLVTVAFIIFWVRSKRSRLLHSDYMNMTPRRPGPTRKHYQPYAPPRDFAAYRSIDRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2193 - protein, 498 aa, Artificial Sequence
  source: /note="Description of Artificial Sequence: Synthetic Chimeric Antigen Receptor sequence"
MALPVTALLLPLALLLHAARPGSAEVQLVQSGAEVKKPGASVKVSCKASGYTFTSYAMHWVRQAPGQRLEWMGWINAGNGNTKYSQKFQGRVTITRDTSASTAYMELSSLRSEDTAVYYCARDISYGSFDYWGQGTLVTVSSGGGGSGGGGSGGGGSSSELTQDPAVSVALGQTVRITCQGDSLRSNYANWYQQKPGQAPVLVIYGQNNRPSGIPDRFSGSSSGNTASLTITGAQAADEADYYCDSRVSTGNHVVFGGGTKLTVLGQASTTTPAPRPPTPAPTIASQPLSLRPEACRPAAGGAVHTRGLDFACDIYIWAPLAGTCGVLLLSLVITLYCRVRKYRSNKGESPVEPAEPCRYSCPREEEGSTIPIQEDYRKPEPACSPRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2194 - protein, 434 aa, Artificial Sequence
  source: /note="Description of Artificial Sequence: Synthetic Chimeric Antigen Receptor sequence"
DAVVTQESALTSSPGETVTLTCRSSTGAVTISNVASWVQEKPDHLFTGLIGGTNNRAPGVPARFSGSLIGDKAALTITGAQTEDEAIYFCVLWYSDHWVFGGGTKLTVLGGGGGSGGGGSGGGGSGGGGSDVQLQESGPGLVAPSQSLSITCTVSGFLLTDVGVNWVRQSPGKGLEWLGVIWGDGITDYNSALKSRLSVTKDNSKSQVFLKMNSLQSGDSARYVCVTGLFDYWGQGTTLTVSSESKVGPPCPPCPDIYIWAPLAGTCGVLLLSLVITLVCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAVSEIGMKGERRRGKGHDGLYQGLSTATKDTYDALHMQALPPR

SEQ ID NO: 2195 - protein, 719 aa, Artificial Sequence
  source: /note="Description of Artificial Sequence: Synthetic Chimeric Antigen Receptor sequence"
METDTLLLWVLLLWVPGSTGQVQLKESGPVLVAPSQTLSITCTVSGFSLASYNIHWVRQPPGKGLEWLGVIWAGGSTNYNSALMSRLSISKDNSKSQVFLQMNSLQTDDTAMYYCAKRSDDYSWFAYWGQGTLVTVSASGGGGSGGGGSGGGGSENVLTQSPAIMSASPGEKVTMTCRASSSVSSSYLHWYQQKSGASPKVWIYSTSNLASGVPGRFSGSGSGTSYSLTISSVEAEDAATYYCQQYSGYPITFGAGTKVEVKRSDPAEPKSPDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKKDPKFWVLVVVGGVLACYSLLVTVAFIIFWVRSKRSRLLHSDYMNMTPRRPGPTRKHYQPYAPPRDFAAYRSRDQRLPPDAHKPPGGGSFRTPIQEEQADAHSTLAKIRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2196 - protein, 157 aa, Artificial Sequence
  source: /note="Description of Artificial Sequence: Synthetic Chimeric Antigen Receptor sequence"
MGTSLLCWMALCLLGADHADACPYSNPSLCSGGGGSELPTQGTFSNVSTNVSPAKPTTTACPYSNPSLCSGGGGSPAPRPPTPAPTIASQPLSLRPEACRPAAGGAVHTRGLDFACDIYIWAPLAGTCGVLLLSLVITLYCNHRNRRRVCKCPRPVV

SEQ ID NO: 2197 - protein, 402 aa, Artificial Sequence
  source: /note="Description of Artificial Sequence: Synthetic Chimeric Antigen Receptor sequence"
MLEGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLESGGGSGVDGFGDVGALESLRGNADLAYILSMEPCGHCLIINNVNFCRESGLRTRTGSNIDCEKLRRRFSSLHFMVEVKGDLTAKKMVLALLELAQQDHGALDCCVVVILSHGCQASHLQFPGAVYGTDGCPVSVEKIVNIFNGTSCPSLGGKPKLFFIQACGGEQKDHGFEVASTSPEDESPGSNPEPDATPFQEGLRTFDQLDAISSLPTPSDIFVSYSTFPGFVSWRDPKSGSWYVETLDDIFEQWAHSEDLQSLLLRVANAVSVKGIYKQMPGCFNFLRKKLFFKTSAS

SEQ ID NO: 2198 - protein, 422 aa, Artificial Sequence
  source: /note="Description of Artificial Sequence: Synthetic Chimeric Antigen Receptor sequence"
DVVMTQSPLSLPVTPGEPASISCRSSQSLVHSNANTYLHWYLQKPGQSPQLLIYKVSNRFSGVPDRFSGSGSGTDFTLKISRVEAEDVGVYYCSQNTHVPPTFGQGTKLEIKRGGGGSGGGGSGGGGSQVQLVQSGAEVKKPGASVKVSCKASGYTFTDYEMHWVRQAPGQGLEWMGALDPKTGDTAYSQKFKGRVTLTADESTSTAYMELSSLRSEDTAVYYCTRFYSYTYWGQGTLVTVSSTTTPAPRPPTPAPTIASQPLSLRPEACRPAAGGAVHTRGLDFACDIYIWAPLAGTCGVLLLSLVITRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPR

SEQ ID NO: 2199 - protein, 456 aa, Artificial Sequence
  source: /note="Description of Artificial Sequence: Synthetic Chimeric Antigen Receptor sequence"
MALPVTALLLPLALLLHAARPDVQLVESGGGLVQPGGSRKLSCAASGFTFSNFGMHWVRQAPEKGLEWVAYISSGGSSINYADTVKGRFTISRDNPKNTLFLQMTSLRSEDTAIYYCTRGGTGTRSLYYFDYWGQGATLIVGGGGSGGGGSGGGGSDIQMTQITSSLSVSLGDRVIISCRASQDIGNFLNWYQQKPDGSLKLLIYYTSRLQSGVPSRFSGWGSGTDYSLTISNLEEEDIATFFCQQGKTLPYTFGGGTKLEIKGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPP

SEQ ID NO: 2200 - protein, 501 aa, Artificial Sequence
  source: /note="Description of Artificial Sequence: Synthetic Chimeric Antigen Receptor sequence"
METDTLLLWVLLLWVPGSTGQVQLQESGPGLVKPSQTLSITCTVSGFSLASYNIHWVRQPPGKGLEWLGVIWAGGSTNYNSALMSRLTISKDNSKNQVFLKMSSLTAADTAVYYCAKRSDDYSWFAYWGQGTLVTVSSGGGGSGGGGSGGGGSENQMTQSPSSLSASVGDRVTMTCRASSSVSSSYLHWYQQKSGKAPKVWIYSTSNLASGVPSRFSGSGSGTDYTLTISSLQPEDFATYYCQQYSGYPITFGQGTKVEIKRSDPAEPKSPDKTHTCPPCPKDPKFWVLVVVGGVLACYSLLVTVAFIIFWVRSKRSRLLHSDYMNMTPRRPGPTRKHYQPYAPPRDFAAYRSRDQRLPPDAHKPPGGGSFRTPIQEEQADAHSTLAKIRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2201 - protein, 527 aa, Artificial Sequence
  source: /note="Description of Artificial Sequence: Synthetic Chimeric Antigen Receptor sequence"
METDTLLLWVLLLWVPGSTGQVQLQESGPGLVKPSQTLSITCTVSGFSLASYNIHWVRQPPGKGLEWLGVIWAGGSTNYNSALMSRLTISKDNSKNQVFLKMSSLTAADTAVYYCAKRSDDYSWFAYWGQGTLVTVSSGGGGSGGGGSGGGGSENQMTQSPSSLSASVGDRVTMTCRASSSVSSSYLHWYQQKSGKAPKVWIYSTSNLASGVPSRFSGSGSGTDYTLTISSLQPEDFATYYCQQYSGYPITFGQGTKVEIKRSDPTTTPAPRPPTPAPTIASQPLSLRPEACRPAAGGAVHTRGLDFACDIFWVLVVVGGVLACYSLLVTVAFIIFWVRSKRSRLLHSDYMNMTPRRPGPTRKHYQPYAPPRDFAAYRSRDQRLPPDAHKPPGGGSFRTPIQEEQADAHSTLAKIRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2202 - protein, 642 aa, Artificial Sequence
  source: /note="Description of Artificial Sequence: Synthetic Chimeric Antigen Receptor sequence"
METDTLLLWVLLLWVPGSTGQVQLQESGPGLVKPSQTLSITCTVSGFSLASYNIHWVRQPPGKGLEWLGVIWAGGSTNYNSALMSRLTISKDNSKNQVFLKMSSLTAADTAVYYCAKRSDDYSWFAYWGQGTLVTVSSGGGGSGGGGSGGGGSENQMTQSPSSLSASVGDRVTMTCRASSSVSSSYLHWYQQKSGKAPKVWIYSTSNLASGVPSRFSGSGSGTDYTLTISSLQPEDFATYYCQQYSGYPITFGQGTKVEIKRSDPAEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKKDPKFWVLVVVGGVLACYSLLVTVAFIIFWVRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2203 - protein, 681 aa, Artificial Sequence
  source: /note="Description of Artificial Sequence: Synthetic Chimeric Antigen Receptor sequence"
METDTLLLWVLLLWVPGSTGQVQLQESGPGLVKPSQTLSITCTVSGFSLASYNIHWVRQPPGKGLEWLGVIWAGGSTNYNSALMSRLTISKDNSKNQVFLKMSSLTAADTAVYYCAKRSDDYSWFAYWGQGTLVTVSSGGGGSGGGGSGGGGSENQMTQSPSSLSASVGDRVTMTCRASSSVSSSYLHWYQQKSGKAPKVWIYSTSNLASGVPSRFSGSGSGTDYTLTISSLQPEDFATYYCQQYSGYPITFGQGTKVEIKRSDPAEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKKDPKFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2204 - protein, 717 aa, Artificial Sequence
  source: /note="Description of Artificial Sequence: Synthetic Chimeric Antigen Receptor sequence"
METDTLLLWVLLLWVPGSTGQVQLQESGPGLVKPSQTLSITCTVSGFSLASYNIHWVRQPPGKGLEWLGVIWAGGSTNYNSALMSRLTISKDNSKNQVFLKMSSLTAADTAVYYCAKRSDDYSWFAYWGQGTLVTVSSGGGGSGGGGSGGGGSENQMTQSPSSLSASVGDRVTMTCRASSSVSSSYLHWYQQKSGKAPKVWIYSTSNLASGVPSRFSGSGSGTDYTLTISSLQPEDFATYYCQQYSGYPITFGQGTKVEIKRSDPAEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKKDPKFWVLVVVGGVLACYSLLVTVAFIIFWVRSKRSRLLHSDYMNMTPRRPGPTRKHYQPYAPPRDFAAYRSRDQRLPPDAHKPPGGGSFRTPIQEEQADAHSTLAKIRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2205 - protein, 718 aa, Artificial Sequence
  source: /note="Description of Artificial Sequence: Synthetic Chimeric Antigen Receptor sequence"
METDTLLLWVLLLWVPGSTGQVQLQESGPGLVKPSQTLSITCTVSGFSLASYNIHWVRQPPGKGLEWLGVIWAGGSTNYNSALMSRLTISKDNSKNQVFLKMSSLTAADTAVYYCAKRSDDYSWFAYWGQGTLVTVSSGGGGSGGGGSGGGGSENQMTQSPSSLSASVGDRVTMTCRASSSVSSSYLHWYQQKSGKAPKVWIYSTSNLASGVPSRFSGSGSGTDYTLTISSLQPEDFATYYCQQYSGYPITFGQGTKVEIKRSDPAEPKSPDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKKDPKFWVLVVVGGVLACYSLLVTVAFIIFWVRSKRSRLLHSDYMNMTPRRPGPTRKHYQPYAPPRDFAAYRSRDQRLPPDAHKPPGGGSFRTPIQEEQADAHSTLAKIRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2206 - protein, 858 aa, Artificial Sequence
  source: /note="Description of Artificial Sequence: Synthetic Chimeric Antigen Receptor sequence"
MGTSLLCWMALCLLGADHADACPYSNPSLCSGGGGSELPTQGTFSNVSTNVSPAKPTTTACPYSNPSLCSGGGGSPAPRPPTPAPTIASQPLSLRPEACRPAAGGAVHTRGLDFACDIYIWAPLAGTCGVLLLSLVITLYCNHRNRRRVCKCPRPVVRAEGRGSLLTCGDVEENPGPMETDTLLLWVLLLWVPGSTGQVQLQESGPGLVKPSQTLSITCTVSGFSLASYNIHWVRQPPGKGLEWLGVIWAGGSTNYNSALMSRLTISKDNSKNQVFLKMSSLTAADTAVYYCAKRSDDYSWFAYWGQGTLVTVSSGGGGSGGGGSGGGGSENQMTQSPSSLSASVGDRVTMTCRASSSVSSSYLHWYQQKSGKAPKVWIYSTSNLASGVPSRFSGSGSGTDYTLTISSLQPEDFATYYCQQYSGYPITFGQGTKVEIKRSDPAEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKKDPKFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2207 - protein, 892 aa, Artificial Sequence
  source: /note="Description of Artificial Sequence: Synthetic Chimeric Antigen Receptor sequence"
QVQLVESGPGVVQPGRSLRISCAVSGFSVTNYGVHWVRQPPGKGLEWLGVIWAGGITNYNSAFMSRLTISKDNSKNTVYLQMNSLRAEDTAMYYCASRGGHYGYALDYWGQGTLVTVSSGSTSGSGKPGSSEGSTKGEIVMTQTPATLSVSAGERVTITCKASQSVSNDVTWYQQKPGQAPRLLIYSASNRYSGVPARFSGSGYGTEFTFTISSVQSEDFAVYFCQQDYSSFGQGTKLEIKFWVLVVVGGVLACYSLLVTVAFIIFWVKRGRKKLLYIFKQPFMRPVQTTQEEDGCSCRFPEEEEGGCELQRRKYRSNKGESPVEPAEPCHYSCPREEEGSTIPIQEDYRKPEPACSPGSTSGSGKPGSSEGSTKGRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSTSGSGKPGSSEGSTKGVGALESLRGNADLAYILSMEPCGHCLIINNVNFCRESGLRTRTGSNIDCEKLRRRFSSLHFMVEVKGDLTAKKMVLALLELAQQDHGALDCCVVVILSHGCQASHLQFPGAVYGTDGCPVSVEKIVNIFNGTSCPSLGGKPKLFFIQACGGEQKDHGFEVASTSPEDESPGSNPEPDATPFQEGLRTFDQLDAISSLPTPSDIFVSYSTFPGFVSWRDPKSGSWYVETLDDIFEQWAHSEDLQSLLLRVANAVSVKGIYKQMPGCFNFLRKKLFFKTSMGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 2208 - protein, 895 aa, Artificial Sequence
  source: /note="Description of Artificial Sequence: Synthetic Chimeric Antigen Receptor sequence"
EVQLVQSGAEVEKPGASVKISCKASGSSFTGYNMNWVRQNIGKSLEWIGAIDPYYGGTSYNQKFKGRATLTVDKSTSTAYMHLKSLRSEDTAVYYCVSGMEYWGQGTSVTVSSGSTSGSGKPGSSEGSTKGDVVMTQTPLSLPVTPGEPASISCRSSQSLVHRNGNTYLHWYLQKPGQSPKLLIHKVSNRFSGVPDRFSGSGSGTDFTLKISRVEAEDLGVYFCSQSTHVPPLTFGAGTKLELKFWVLVVVGGVLACYSLLVTVAFIIFWVKRGRKKLLYIFKQPFMRPVQTTQEEDGCSCRFPEEEEGGCELQRRKYRSNKGESPVEPAEPCHYSCPREEEGSTIPIQEDYRKPEPACSPGSTSGSGKPGSSEGSTKGRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSTSGSGKPGSSEGSTKGVGALESLRGNADLAYILSMEPCGHCLIINNVNFCRESGLRTRTGSNIDCEKLRRRFSSLHFMVEVKGDLTAKKMVLALLELAQQDHGALDCCVVVILSHGCQASHLQFPGAVYGTDGCPVSVEKIVNIFNGTSCPSLGGKPKLFFIQACGGEQKDHGFEVASTSPEDESPGSNPEPDATPFQEGLRTFDQLDAISSLPTPSDIFVSYSTFPGFVSWRDPKSGSWYVETLDDIFEQWAHSEDLQSLLLRVANAVSVKGIYKQMPGCFNFLRKKLFFKTSMGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 2209 - protein, 900 aa, Artificial Sequence
  source: /note="Description of Artificial Sequence: Synthetic Chimeric Antigen Receptor sequence"
EVKLVESGGGLVLPGDSLRLSCATSEFTFTDYYMTWVRQPPRKALEWLGFIRNRANGYTTEYNPSVKGRFTISRDNSQSILYLQMNTLRTEDSATYYCARVSNWAFDYWGQGTTLTVSSGSTSGSGKPGSSEGSTKGDVVMTQTPLSLPVSLGDQASISCRSSQSLLKNNGNTFLHWYLQKSGQSPKLLIYKVSNRLSGVPDRFSGSGSGTYFTLKISRVEAEDLGVYFCSQSTHIPYTFGGGTKLEIKFWVLVVVGGVLACYSLLVTVAFIIFWVKRGRKKLLYIFKQPFMRPVQTTQEEDGCSCRFPEEEEGGCELQRRKYRSNKGESPVEPAEPCHYSCPREEEGSTIPIQEDYRKPEPACSPGSTSGSGKPGSSEGSTKGRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSTSGSGKPGSSEGSTKGVGALESLRGNADLAYILSMEPCGHCLIINNVNFCRESGLRTRTGSNIDCEKLRRRFSSLHFMVEVKGDLTAKKMVLALLELAQQDHGALDCCVVVILSHGCQASHLQFPGAVYGTDGCPVSVEKIVNIFNGTSCPSLGGKPKLFFIQACGGEQKDHGFEVASTSPEDESPGSNPEPDATPFQEGLRTFDQLDAISSLPTPSDIFVSYSTFPGFVSWRDPKSGSWYVETLDDIFEQWAHSEDLQSLLLRVANAVSVKGIYKQMPGCFNFLRKKLFFKTSMGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 2210 - protein, 1103 aa, Artificial Sequence
  source: /note="Description of Artificial Sequence: Synthetic Chimeric Antigen Receptor sequence"
MLEGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLESGGGSGVDGFGDVGALESLRGNADLAYILSMEPCGHCLIINNVNFCRESGLRTRTGSNIDCEKLRRRFSSLHFMVEVKGDLTAKKMVLALLELAQQDHGALDCCVVVILSHGCQASHLQFPGAVYGTDGCPVSVEKIVNIFNGTSCPSLGGKPKLFFIQACGGEQKDHGFEVASTSPEDESPGSNPEPDATPFQEGLRTFDQLDAISSLPTPSDIFVSYSTFPGFVSWRDPKSGSWYVETLDDIFEQWAHSEDLQSLLLRVANAVSVKGIYKQMPGCFNFLRKKLFFKTSASRAEGRGSLLTCGDVEENPGPMETDTLLLWVLLLWVPGSTGQVQLQESGPGLVKPSQTLSITCTVSGFSLASYNIHWVRQPPGKGLEWLGVIWAGGSTNYNSALMSRLTISKDNSKNQVFLKMSSLTAADTAVYYCAKRSDDYSWFAYWGQGTLVTVSSGGGGSGGGGSGGGGSENQMTQSPSSLSASVGDRVTMTCRASSSVSSSYLHWYQQKSGKAPKVWIYSTSNLASGVPSRFSGSGSGTDYTLTISSLQPEDFATYYCQQYSGYPITFGQGTKVEIKRSDPAEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKKDPKFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2211 - protein, 454 aa, Artificial Sequence
  source: /note="Description of Artificial Sequence: Synthetic Chimeric Antigen Receptor sequence"
MALPVTALLLPLALLLHAARPQVQLQQSGGGLVKPGGSLTLSCAASRFTFSTYAMSWVRQTPAKRLEWVAYISSGGASTYYRDSVKGRFTISRDNAKNTLYLQMSSLRSEDTAMYYCARGGSRYAMDYWGQGTTVTVSSGGGGSGGGGSGGGGSDIQLTQSPAILSVSPGERVSFSCWASQSIGTSIHWYQQRTNGSPRLLIKYSSESISGIPSRFSGSGSGTDFTLSINSLESEDIADYYCQQTYSWPFTFGSGTKLEIGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2212 - protein, 456 aa, Artificial Sequence
  source: /note="Description of Artificial Sequence: Synthetic Chimeric Antigen Receptor sequence"
MALPVTALLLPLALLLHAARPEVTLVESGGDFVKPGGSLKVSCAASGFAFSHYAMSWVRQTPAKRLEWVAYISSGGSGTYYSDSVKGRFTISRDNAKNTLYLQMRSLRSEDSAMYFCTRVKLGTYYFDSWGQGTTLTVSSGGGGSGGGGSGGGGSDIQMTQTASSLPASLGDRVTISCSASQDISNYLNWYQQKPDGTVKLLIFYSSNLHSGVPSRFSGGGSGTDYSLTISNLEPEDIATYFCHQYSKLPWTFGGGTKLEIKGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2213 - protein, 459 aa, Artificial Sequence
  source: /note="Description of Artificial Sequence: Synthetic Chimeric Antigen Receptor sequence"
MALPVTALLLPLALLLHAARPEVVVVESGGGFVKPGGSLKLSCAAAGFTFSRYAMSWVRQTPEKRLEWVATISSGGSHTYYPDSVKGRFTISRDNAKNTLYLQMSSLRSEDTAIYYCARPGYDRGAWFFDVWGAGTTVTVSSGGGGSGGGGSGGGGSDIVLTQSPATLSVTPGDSVSLSCRASQIISNNLHWYQQKSHESPRLLIKYASQSISGIPSRFSGSGSGTDFTLSINSVETEDFGMYFCQQSNSWPLTFGSGTKLEIKRGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2214 - protein, 483 aa, Artificial Sequence
  source: /note="Description of Artificial Sequence: Synthetic Chimeric Antigen Receptor sequence"
MALPVTALLLPLALLLHAARPQVQLQQSGGGLVKPGGSLTLSCAASRFTFSTYAMSWVRQTPAKRLEWVAYISSGGASTYYRDSVKGRFTISRDNAKNTLYLQMSSLRSEDTAMYYCARGGSRYAMDYWGQGTTVTVSSGGGGSGGGGSGGGGSDIQLTQSPAILSVSPGERVSFSCWASQSIGTSIHWYQQRTNGSPRLLIKYSSESISGIPSRFSGSGSGTDFTLSINSLESEDIADYYCQQTYSWPFTFGSGTKLEITTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2215 - protein, 485 aa, Artificial Sequence
  source: /note="Description of Artificial Sequence: Synthetic Chimeric Antigen Receptor sequence"
MALPVTALLLPLALLLHAARPEVTLVESGGDFVKPGGSLKVSCAASGFAFSHYAMSWVRQTPAKRLEWVAYISSGGSGTYYSDSVKGRFTISRDNAKNTLYLQMRSLRSEDSAMYFCTRVKLGTYYFDSWGQGTTLTVSSGGGGSGGGGSGGGGSDIQMTQTASSLPASLGDRVTISCSASQDISNYLNWYQQKPDGTVKLLIFYSSNLHSGVPSRFSGGGSGTDYSLTISNLEPEDIATYFCHQYSKLPWTFGGGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2216 - protein, 486 aa, Artificial Sequence
  source: /note="Description of Artificial Sequence: Synthetic Chimeric Antigen Receptor sequence"
MALPVTALLLPLALLLHAARPDVQLVESGGGLVQPGGSRKLSCAASGFTFSNFGMHWVRQAPEKGLEWVAYISSGGSSINYADTVKGRFTISRDNPKNTLFLQMTSLRSEDTAIYYCTRGGTGTRSLYYFDYWGQGATLIVGGGGSGGGGSGGGGSDIQMTQITSSLSVSLGDRVIISCRASQDIGNFLNWYQQKPDGSLKLLIYYTSRLQSGVPSRFSGWGSGTDYSLTISNLEEEDIATFFCQQGKTLPYTFGGGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2217 - protein, 488 aa, Artificial Sequence
  source: /note="Description of Artificial Sequence: Synthetic Chimeric Antigen Receptor sequence"
MALPVTALLLPLALLLHAARPEVVVVESGGGFVKPGGSLKLSCAAAGFTFSRYAMSWVRQTPEKRLEWVATISSGGSHTYYPDSVKGRFTISRDNAKNTLYLQMSSLRSEDTAIYYCARPGYDRGAWFFDVWGAGTTVTVSSGGGGSGGGGSGGGGSDIVLTQSPATLSVTPGDSVSLSCRASQIISNNLHWYQQKSHESPRLLIKYASQSISGIPSRFSGSGSGTDFTLSINSVETEDFGMYFCQQSNSWPLTFGSGTKLEIKRTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2218 - protein, 669 aa, Artificial Sequence
  source: /note="Description of Artificial Sequence: Synthetic Chimeric Antigen Receptor sequence"
MALPVTALLLPLALLLHAARPQVQLQQSGGGLVKPGGSLTLSCAASRFTFSTYAMSWVRQTPAKRLEWVAYISSGGASTYYRDSVKGRFTISRDNAKNTLYLQMSSLRSEDTAMYYCARGGSRYAMDYWGQGTTVTVSSGGGGSGGGGSGGGGSDIQLTQSPAILSVSPGERVSFSCWASQSIGTSIHWYQQRTNGSPRLLIKYSSESISGIPSRFSGSGSGTDFTLSINSLESEDIADYYCQQTYSWPFTFGSGTKLEIEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2219 - protein, 671 aa, Artificial Sequence
  source: /note="Description of Artificial Sequence: Synthetic Chimeric Antigen Receptor sequence"
MALPVTALLLPLALLLHAARPEVTLVESGGDFVKPGGSLKVSCAASGFAFSHYAMSWVRQTPAKRLEWVAYISSGGSGTYYSDSVKGRFTISRDNAKNTLYLQMRSLRSEDSAMYFCTRVKLGTYYFDSWGQGTTLTVSSGGGGSGGGGSGGGGSDIQMTQTASSLPASLGDRVTISCSASQDISNYLNWYQQKPDGTVKLLIFYSSNLHSGVPSRFSGGGSGTDYSLTISNLEPEDIATYFCHQYSKLPWTFGGGTKLEIKEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2220 - protein, 672 aa, Artificial Sequence
  source: /note="Description of Artificial Sequence: Synthetic Chimeric Antigen Receptor sequence"
MALPVTALLLPLALLLHAARPDVQLVESGGGLVQPGGSRKLSCAASGFTFSNFGMHWVRQAPEKGLEWVAYISSGGSSINYADTVKGRFTISRDNPKNTLFLQMTSLRSEDTAIYYCTRGGTGTRSLYYFDYWGQGATLIVGGGGSGGGGSGGGGSDIQMTQITSSLSVSLGDRVIISCRASQDIGNFLNWYQQKPDGSLKLLIYYTSRLQSGVPSRFSGWGSGTDYSLTISNLEEEDIATFFCQQGKTLPYTFGGGTKLEIKEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2221 - protein, 674 aa, Artificial Sequence
  source: /note="Description of Artificial Sequence: Synthetic Chimeric Antigen Receptor sequence"
MALPVTALLLPLALLLHAARPEVVVVESGGGFVKPGGSLKLSCAAAGFTFSRYAMSWVRQTPEKRLEWVATISSGGSHTYYPDSVKGRFTISRDNAKNTLYLQMSSLRSEDTAIYYCARPGYDRGAWFFDVWGAGTTVTVSSGGGGSGGGGSGGGGSDIVLTQSPATLSVTPGDSVSLSCRASQIISNNLHWYQQKSHESPRLLIKYASQSISGIPSRFSGSGSGTDFTLSINSVETEDFGMYFCQQSNSWPLTFGSGTKLEIKREPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2222 - protein, 415 aa, Artificial Sequence
  source: /note="Description of Artificial Sequence: Synthetic Chimeric Antigen Receptor sequence"
MDWIWRILFLVGAATGAHSQVQLQQSGAELVRPGASVKLSCKASGYTFTDYEMHWVKQTPVHGLKWIGALDPKTGDTAYSQKFKGKATLTADKSSSTAYMELRSLTSEDSAVYYCTRFYSYTYWGQGTLVTVSAGGGGSGGGGSGGGGSDVVMTQTPLSLPVSLGDQASISCRSSQSLVHSNGNTYLHWYLQKPGQSPKLLIYKVSNRFSGVPDRFSGSGSGTDFTLKISRVEAEDLGVYFCSQNTHVPPTFGSGTKLEIKEPKSCDKTHTCPPCPDPKFWVLVVVGGVLACYSLLVTVAFIIRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2223 - protein, 396 aa, Artificial Sequence
  source: /note="Description of Artificial Sequence: Synthetic Chimeric Antigen Receptor sequence"
QVQLQQSGAELVRPGASVKLSCKASGYTFTDYEMHWVKQTPVHGLKWIGALDPKTGDTAYSQKFKGKATLTADKSSSTAYMELRSLTSEDSAVYYCTRFYSYTYWGQGTLVTVSAGGGGSGGGGSGGGGSDVVMTQTPLSLPVSLGDQASISCRSSQSLVHSNGNTYLHWYLQKPGQSPKLLIYKVSNRFSGVPDRFSGSGSGTDFTLKISRVEAEDLGVYFCSQNTHVPPTFGSGTKLEIKEPKSCDKTHTCPPCPDPKFWVLVVVGGVLACYSLLVTVAFIIRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2224 - protein, 438 aa, Artificial Sequence
  source: /note="Description of Artificial Sequence: Synthetic Chimeric Antigen Receptor sequence"
QVQLQQSGAELVRPGASVKLSCKASGYTFTDYEMHWVKQTPVHGLKWIGALDPKTGDTAYSQKFKGKATLTADKSSSTAYMELRSLTSEDSAVYYCTRFYSYTYWGQGTLVTVSAGGGGSGGGGSGGGGSDVVMTQTPLSLPVSLGDQASISCRSSQSLVHSNGNTYLHWYLQKPGQSPKLLIYKVSNRFSGVPDRFSGSGSGTDFTLKISRVEAEDLGVYFCSQNTHVPPTFGSGTKLEIKEPKSCDKTHTCPPCPDPKFWVLVVVGGVLACYSLLVTVAFIIKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2225 - protein, 440 aa, Artificial Sequence
  source: /note="Description of Artificial Sequence: Synthetic Chimeric Antigen Receptor sequence"
QVQLQQSGAELVRPGASVKLSCKASGYTFTDYEMHWVKQTPVHGLKWIGALDPKTGDTAYSQKFKGKATLTADKSSSTAYMELRSLTSEDSAVYYCTRFYSYTYWGQGTLVTVSAGGGGSGGGGSGGGGSDVVMTQTPLSLPVSLGDQASISCRSSQSLVHSNGNTYLHWYLQKPGQSPKLLIYKVSNRFSGVPDRFSGSGSGTDFTLKISRVEAEDLGVYFCSQNTHVPPTFGSGTKLEIKEPKSCDKTHTCPPCPDPKFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2226 - protein, 457 aa, Artificial Sequence
  source: /note="Description of Artificial Sequence: Synthetic Chimeric Antigen Receptor sequence"
MDWIWRILFLVGAATGAHSQVQLQQSGAELVRPGASVKLSCKASGYTFTDYEMHWVKQTPVHGLKWIGALDPKTGDTAYSQKFKGKATLTADKSSSTAYMELRSLTSEDSAVYYCTRFYSYTYWGQGTLVTVSAGGGGSGGGGSGGGGSDVVMTQTPLSLPVSLGDQASISCRSSQSLVHSNGNTYLHWYLQKPGQSPKLLIYKVSNRFSGVPDRFSGSGSGTDFTLKISRVEAEDLGVYFCSQNTHVPPTFGSGTKLEIKEPKSCDKTHTCPPCPDPKFWVLVVVGGVLACYSLLVTVAFIIKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2227 - protein, 459 aa, Artificial Sequence
  source: /note="Description of Artificial Sequence: Synthetic Chimeric Antigen Receptor sequence"
MDWIWRILFLVGAATGAHSQVQLQQSGAELVRPGASVKLSCKASGYTFTDYEMHWVKQTPVHGLKWIGALDPKTGDTAYSQKFKGKATLTADKSSSTAYMELRSLTSEDSAVYYCTRFYSYTYWGQGTLVTVSAGGGGSGGGGSGGGGSDVVMTQTPLSLPVSLGDQASISCRSSQSLVHSNGNTYLHWYLQKPGQSPKLLIYKVSNRFSGVPDRFSGSGSGTDFTLKISRVEAEDLGVYFCSQNTHVPPTFGSGTKLEIKEPKSCDKTHTCPPCPDPKFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2228 - protein, 482 aa, Artificial Sequence
  source: /note="Description of Artificial Sequence: Synthetic Chimeric Antigen Receptor sequence"
QVQLQQSGAELVRPGASVKLSCKASGYTFTDYEMHWVKQTPVHGLKWIGALDPKTGDTAYSQKFKGKATLTADKSSSTAYMELRSLTSEDSAVYYCTRFYSYTYWGQGTLVTVSAGGGGSGGGGSGGGGSDVVMTQTPLSLPVSLGDQASISCRSSQSLVHSNGNTYLHWYLQKPGQSPKLLIYKVSNRFSGVPDRFSGSGSGTDFTLKISRVEAEDLGVYFCSQNTHVPPTFGSGTKLEIKEPKSCDKTHTCPPCPDPKFWVLVVVGGVLACYSLLVTVAFIIFWVRSKRSRLLHSDYMNMTPRRPGPTRKHYQPYAPPRDFAAYRSKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2229 - protein, 501 aa, Artificial Sequence
  source: /note="Description of Artificial Sequence: Synthetic Chimeric Antigen Receptor sequence"
MDWIWRILFLVGAATGAHSQVQLQQSGAELVRPGASVKLSCKASGYTFTDYEMHWVKQTPVHGLKWIGALDPKTGDTAYSQKFKGKATLTADKSSSTAYMELRSLTSEDSAVYYCTRFYSYTYWGQGTLVTVSAGGGGSGGGGSGGGGSDVVMTQTPLSLPVSLGDQASISCRSSQSLVHSNGNTYLHWYLQKPGQSPKLLIYKVSNRFSGVPDRFSGSGSGTDFTLKISRVEAEDLGVYFCSQNTHVPPTFGSGTKLEIKEPKSCDKTHTCPPCPDPKFWVLVVVGGVLACYSLLVTVAFIIFWVRSKRSRLLHSDYMNMTPRRPGPTRKHYQPYAPPRDFAAYRSKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2230 - DNA, 1380 bp, Artificial Sequence
  source: /note="Description of Artificial Sequence: Synthetic Chimeric Antigen Receptor sequence"
atggattggatttggcgcattctgtttctggtgggagccgcaaccggagcacatagtcaggtccagctgcagcagtcaggagccgaactggtgcggcccggcgcaagtgtcaaactgtcatgcaaggccagcgggtataccttcacagactacgagatgcactgggtgaaacagacccctgtgcacggcctgaagtggatcggcgctctggacccaaaaaccggggatacagcatattcccagaagtttaaaggaaaggccactctgaccgctgacaagagctcctctactgcctacatggagctgaggagcctgacatccgaagatagcgccgtgtactattgcacccgcttctactcctatacatactggggccaggggactctggtgaccgtctctgcaggaggaggaggctctggaggaggagggagtggaggcgggggaagcgacgtggtcatgacacagactccactgtccctgcccgtgagcctgggcgatcaggctagcatttcctgtcgaagttcacagagtctggtgcactcaaacggaaatacctatctgcattggtacctgcagaagccaggccagtctcccaaactgctgatctataaggtgagcaaccggttctccggggtccctgacagattttctggaagtggctcagggacagatttcactctgaaaattagcagagtggaggccgaagatctgggcgtctacttttgtagccagaatacccacgtcccaccaacattcggaagcggcactaaactggaaatcaaggagcccaaatcttgtgacaaaactcacacatgcccaccgtgcccggatccgaaagatcccaaattttgggtgctggtggtggttggtggagtcctggcttgctatagcttgctagtaacagtggcctttattattaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 2231 - protein, 464 aa, Artificial Sequence
  source: /note="Description of Artificial Sequence: Synthetic Chimeric Antigen Receptor sequence"
DVVMTQSPLSLPVTPGEPASISCRSSQSLVHSNANTYLHWYLQKPGQSPQLLIYKVSNRFSGVPDRFSGSGSGTDFTLKISRVEAEDVGVYYCSQNTHVPPTFGQGTKLEIKRGGGGSGGGGSGGGGSQVQLVQSGAEVKKPGASVKVSCKASGYTFTDYEMHWVRQAPGQGLEWMGALDPKTGDTAYSQKFKGRVTLTADESTSTAYMELSSLRSEDTAVYYCTRFYSYTYWGQGTLVTVSSTTTPAPRPPTPAPTIASQPLSLRPEACRPAAGGAVHTRGLDFACDIYIWAPLAGTCGVLLLSLVITKRGRKKLLYIFKQPFMRPVQTTQEEDGCSCRFPEEEEGGCELRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPR

SEQ ID NO: 2232 - protein, 469 aa, Artificial Sequence
  source: /note="Description of Artificial Sequence: Synthetic Chimeric Antigen Receptor sequence"
DVVMTQSPLSLPVTPGEPASISCRSSQSLVHSNANTYLHWYLQKPGQSPQLLIYKVSNRFSGVPDRFSGSGSGTDFTLKISRVEAEDVGVYYCSQNTHVPPTFGQGTKLEIKRGGGGSGGGGSGGGGSQVQLVQSGAEVKKPGASVKVSCKASGYTFTDYEMHWVRQAPGQGLEWMGALDPKTGDTAYSQKFKGRVTLTADESTSTAYMELSSLRSEDTAVYYCTRFYSYTYWGQGTLVTVSSTTTPAPRPPTPAPTIASQPLSLRPEACRPAAGGAVHTRGLDFACDFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPR

SEQ ID NO: 2233 - protein, 500 aa, Artificial Sequence
  source: /note="Description of Artificial Sequence: Synthetic Chimeric Antigen Receptor sequence"
DIQMTQSPSSLSASVGDRVTITCRASQNIATDVSTAVAWIQQKPGKAPKLLIYSASFLYSGVPSRFSGSGSGTDFTLTISSLQPEDFATYYCQQSEPEPYTFGQGTKVEIKRGSTSGSGKPGSGEGSTKGEVQLVESGGGLVQPGGSLRLSCAASGFTLSGDWVIHWVRQAPGKGLEWVGEISAAGGYTDYADSVKGRFTISADTSKNTAYLQMNSLRAEDTAVYYCARESRVSFEAAMDYWGQGTLVPSDIAVEWESNGQPENNYKTTPPVLDSDGSFFLYSRLTVDKSRWQEGNVFSCSVMHEALHNHYTQKSLSLSLGKWVLVVVGGVLACYSLLVTVAFIIKRGRKKLLYIFKQPFMRPVQTTQEEDGCSCRFPEEEEGGCELRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPR

SEQ ID NO: 2234 - protein, 511 aa, Artificial Sequence
  source: /note="Description of Artificial Sequence: Synthetic Chimeric Antigen Receptor sequence"
DVVMTQSPLSLPVTPGEPASISCRSSQSLVHSNANTYLHWYLQKPGQSPQLLIYKVSNRFSGVPDRFSGSGSGTDFTLKISRVEAEDVGVYYCSQNTHVPPTFGQGTKLEIKRGGGGSGGGGSGGGGSQVQLVQSGAEVKKPGASVKVSCKASGYTFTDYEMHWVRQAPGQGLEWMGALDPKTGDTAYSQKFKGRVTLTADESTSTAYMELSSLRSEDTAVYYCTRFYSYTYWGQGTLVTVSSTTTPAPRPPTPAPTIASQPLSLRPEACRPAAGGAVHTRGLDFACDFWVLVVVGGVLACYSLLVTVAFIIFWVRSKRSRLLHSDYMNMTPRRPGPTRKHYQPYAPPRDFAAYRSKRGRKKLLYIFKQPFMRPVQTTQEEDGCSCRFPEEEEGGCELRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPR

SEQ ID NO: 2235 - protein, 503 aa, Artificial Sequence
  source: /note="Description of Artificial Sequence: Synthetic Chimeric Antigen Receptor sequence"
DIQMTQSPSSLSASVGDRVTITCRASQNIATDVSTAVAWIQQKPGKAPKLLIYSASFLYSGVPSRFSGSGSGTDFTLTISSLQPEDFATYYCQQSEPEPYTFGQGTKVEIKRGSTSGSGKPGSGEGSTKGEVQLVESGGGLVQPGGSLRLSCAASGFTLSGDWVIHWVRQAPGKGLEWVGEISAAGGYTDYADSVKGRFTISADTSKNTAYLQMNSLRAEDTAVYYCARESRVSFEAAMDYWGQGTLVPSDIAVEWESNGQPENNYKTTPPVLDSDGSFFLYSRLTVDKSRWQEGNVFSCSVMHEALHNHYTQKSLSLSLGKFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPR

SEQ ID NO: 2236 - protein, 818 aa, Artificial Sequence
  source: /note="Description of Artificial Sequence: Synthetic Chimeric Antigen Receptor sequence"
MLLLVTSLLLCELPHPAFLLIPEVQLVESGGGLVQPGGSLRLSCAASGFNIKDTYIHWVRQSPGKGLEWVARIYPTNGYTRYADSVKGRFTISADTSKNTAYLQMNSLRAEDTAIYYCSRWGGDGFYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCESKYGPPCPPCPGGGSSGGGSGGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKMFWVLVVVGGVLACYSLLVTVAFIIFWVRSKRSRGGHSDYMNMTPRRPGPTRKHYQPYAPPRDFAAYRSGGGRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRLEGGGEGRGSLLTCGDVEENPGPRMLLLVTSLLLCELPHPAFLLIPDIQMTQSPILLSASVGDRVTITCRASQDVNTAVAWYQQRTNGSPRLLIYSASFLYSGVPSRFSGSRSGTDFTLTISSLQPEDEADYYCQQHYTTPPTFGAGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 2237 - protein, 438 aa, Artificial Sequence
  source: /note="Description of Artificial Sequence: Synthetic Chimeric Antigen Receptor sequence"
DIQMTQSPSSLSASVGDRVTITCRASQDVNTAVAWYQQKPGKAPKLLIVSASFLVSGVPSRFSGSRSGTDFTLTISSLQPEDFATYVCQQHYTTPPTFGQGTKVEIKRTGGGGSGGGGSGGGGSEVQLVESGGGLVQPGGSLRLSCAASGFNIKDTYIHWVRQAPGKGLEWVARIYPTNGYTRYADSVKGRFTISADTSKNTAYLQMNSLRAEDTAVVYCSRWGGDGFYAMDYWGQGTLVTVSSAAAESKVGPPCPPCPDIYIWAPLAGTCGVLLLSLVITLVCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAVSEIGMKGERRRGKGHDGLYQGLSTATKDTYDALHMQALPPR

SEQ ID NO: 2238 - protein, 438 aa, Artificial Sequence
  source: /note="Description of Artificial Sequence: Synthetic Chimeric Antigen Receptor sequence"
DIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKRTGGGGSGGGGSGGGGSEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSAAAESKYGPPCPPCPDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2239 - protein, 470 aa, Artificial Sequence
  source: /note="Description of Artificial Sequence: Synthetic Chimeric Antigen Receptor sequence"
DIQMTQSPSSLSASVGDRVTITCRASQDVNTAVAWYQQKPGKAPKLLIVSASFLVSGVPSRFSGSRSGTDFTLTISSLQPEDFATYVCQQHYTTPPTFGQGTKVEIKRTGGGGSGGGGSGGGGSEVQLVESGGGLVQPGGSLRLSCAASGFNIKDTYIHWVRQAPGKGLEWVARIYPTNGYTRYADSVKGRFTISADTSKNTAYLQMNSLRAEDTAVVYCSRWGGDGFYAMDYWGQGTLVTVSSAAATTTPAPRPPTPAPTIASQPLSLRPEACRPAAGGAVHTRGLDFACDIYIWAPLAGTCGVLLLSLVITLVCKRGRKKLLYIFKQPFMRPVQTIQEEDGCSCRFPEEEEGGCELRVKFSRSADAPAYKQGQNQLYNELNLGRREEYDVLDKRRGRDPEMGGKPRRKNPQEGLYNELQKDKMAEAVSEIGMKGERRRGKGHDGLYQGLSTATKDTYDALHMQALPPR

SEQ ID NO: 2240 - protein, 470 aa, Artificial Sequence
  source: /note="Description of Artificial Sequence: Synthetic Chimeric Antigen Receptor sequence"
DIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKRTGGGGSGGGGSGGGGSEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSAAATTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2241 - protein, 680 aa, Artificial Sequence
  source: /note="Description of Artificial Sequence: Synthetic Chimeric Antigen Receptor sequence"
MLLLVTSLLLCELPHPAFLLIPMAQVKLQQSGPDLVKPGASVKISCKASGYSFTGYYMHWVKQSHGKSLEWIGRVNPNSGGTSYNQKFKDKAILTVDKSSSTAYMELRSLTSEDSAVYYCARSKGNYFYAMDYWGQGTTVTVSSSGGGSGGGGSGGGGSDIELTQSPSSLAVSLGQRATISCRASESVDSHGTSLMHWYQQKPGQPPKFLIYRASNLESGIPARFSGSGSRTDFTLTINPVETDDVAIYYCQQSNEDPPTFGGGTKLELKESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKMFWVLVVVGGVLACYSLLVTVAFIIFWVRSKRSRGGHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2242 - protein, 816 aa, Artificial Sequence
  source: /note="Description of Artificial Sequence: Synthetic Chimeric Antigen Receptor sequence"
MLLLVTSLLLCELPHPAFLLIPDIQMTQSPILLSASVGDRVTITCRASQDVNTAVAWYQQRTNGSPRLLIYSASFLYSGVPSRFSGSRSGTDFTLTISSLQPEDEADYYCQQHYTTPPTFGAGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECLEGGGEGRGSLLTCGDVEENPGMLLLVTSLLLCELPHPAFLLIPEVQLVESGGGLVQPGGSLRLSCAASGFNIKDTYIHWVRQSPGKGLEWVARIYPTNGYTRYADSVKGRFTISADTSKNTAYLQMNSLRAEDTAIYYCSRWGGDGFYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCESKYGPPCPPCPGGGSSGGGSGGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKMFWVLVVVGGVLACYSLLVTVAFIIFWVRSKRSRGGHSDYMNMTPRRPGPTRKHYQPYAPPRDFAAYRSGGGRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2243 - protein, 1162 aa, Artificial Sequence
  source: /note="Description of Artificial Sequence: Synthetic Chimeric Antigen Receptor sequence"
MLLLVTSLLLCELPHPAFLLIPEVQLVESGGGLVQPGGSLRLSCAASGFNIKDTYIHWVRQSPGKGLEWVARIYPTNGYTRYADSVKGRFTISADTSKNTAYLQMNSLRAEDTAIYYCSRWGGDGFYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCESKYGPPCPPCPGGGSSGGGSGGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKMFWVLVVVGGVLACYSLLVTVAFIIFWVRSKRSRGGHSDYMNMTPRRPGPTRKHYQPYAPPRDFAAYRSGGGRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRLEGGGEGRGSLLTCGDVEENPGPRMPPPRLLFFLLFLTPMEVRPEEPLVVKVEEGDNAVLQCLKGTSDGPTQQLTWSRESPLKPFLKLSLGLPGLGIHMRPLAIWLFIFNVSQQMGGFYLCQPGPPSEKAWQPGWTVNVEGSGELFRWNVSDLGGLGCGLKNRSSEGPSSPSGKLMSPKLYVWAKDRPEIWEGEPPCVPPRDSLNQSLSQDLTMAPGSTLWLSCGVPPDSVSRGPLSWTHVHPKGPKSLLSLELKDDRPARDMWVMETGLLLPRATAQDAGKYYCHRGNLTMSFHLEITARPVLWHWLLRTGGWKVSAVTLAYLIFCLCSLVGILHLQRALVLRRKRGGSTSEGRGSLLTCGDVEENPGPMETDTLLLWVLLLWVPGSTGDIQMTQSPILLSASVGDRVTITCRASQDVNTAVAWYQQRTNGSPRLLIYSASFLYSGVPSRFSGSRSGTDFTLTISSLQPEDEADYYCQQHYTTPPTFGAGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 2244 - protein, 606 aa, Artificial Sequence
  source: /note="Description of Artificial Sequence: Synthetic Chimeric Antigen Receptor sequence"
MHPLLNPLLLALGLMALLLTTVIALTCLGGFASPGPVPPSTALRELIEELVNITQNQKAPLCNGSMVWSINLTAGMYCAALESLINVSGCSAIEKTQRMLSGFCPHKVSAGQFSSLHVRDTKIEVAQFVKDLLLHLKKLFREGQFNPRKPTTTPAPRPPTPAPTIASQPLSLRPEACRPAAGGAVHTRGLDFAQLLCYLLDGILFIYGVILTALFLRVVTFWVRSKRSRLLHSDYMNMTPRRPGPTRKHYQPYAPPRDFAAYRSTRKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRQPAAAEGRGSLLTCGDVEENPGPMDKDCEMKRTTLDSPLGKLELSGCEQGLHEIKLLGKGTSAADAVEVPAPAAVLGGPEPLMQCTAWLNAYFHQPEAIEEFPVPALHHPVFQQESFTRQVLWKLLKVVKFGEVISYQQLAALAGNPKAARAVGGAMRGNPVKILIPCHRVVCSSGAVGNYSGGLAVKEWLLAHEGHRLGKPGLGGSSGLAGAWLKGAGATSGSPPAGRN

SEQ ID NO: 2245 - protein, 330 aa, Artificial Sequence
  source: /note="Description of Artificial Sequence: Synthetic Chimeric Antigen Receptor sequence"
MVRGVPFRHLLLVLQLALLPAATQGKKVVLGKKGDTVELTCTASQKKSIQFHWKNSNQIKILGNQGSFLTKGPSKLNDRADSRRSLWDQGNFPLIIKNLKIEDSDTYICEVEDQKEEVQLLVFGLTANSDTHLLQGQSLTLTLESPPGSSPSVQCRSPRGKNIQGGKTLSVSQLELQDSGTWTCTVLQNQKKVEFKIDIVVLAFQKASGGGGSKQVGNKFFLTNGEIMTFEKVKALCVKFQASVATPRNAAENGAIQNLIKEEAFLGITDEKTEGQFVDLTGNRLTYTNWNEGEPNNAGSDEDCVLLLKNGQWNDVPCSTSHLAVCEFPI

SEQ ID NO: 2246 - protein, 354 aa, Artificial Sequence
  source: /note="Description of Artificial Sequence: Synthetic Chimeric Antigen Receptor sequence"
MVRGVPFRHLLLVLQLALLPAATQGKKVVLGKKGDTVELTCTASQKKSIQFHWKNSNQIKILGNQGSFLTKGPSKLNDRADSRRSLWDQGNFPLIIKNLKIEDSDTYICEVEDQKEEVQLLVFGLTANSDTHLLQGQSLTLTLESPPGSSPSVQCRSPRGKNIQGGKTLSVSQLELQDSGTWTCTVLQNQKKVEFKIDIVVLAFQKASGGGGSQNDILQVVSQGWKYFKGNFYYFSLIPKTWYSAEQFCVSRNSHLTSVTSESEQEFLYKTAGGLIYWIGLTKAGMEGDWSWVDDTPFNKVQSVRFWIPGEPNNAGNNEHCGNIKAPSLQAWNDAPCDKTFLFICKRPYVPSEP

SEQ ID NO: 2247 - protein, 362 aa, Artificial Sequence
  source: /note="Description of Artificial Sequence: Synthetic Chimeric Antigen Receptor sequence"
MVRGVPFRHLLLVLQLALLPAATQGKKVVLGKKGDTVELTCTASQKKSIQFHWKNSNQIKILGNQGSFLTKGPSKLNDRADSRRSLWDQGNFPLIIKNLKIEDSDTYICEVEDQKEEVQLLVFGLTANSDTHLLQGQSLTLTLESPPGSSPSVQCRSPRGKNIQGGKTLSVSQLELQDSGTWTCTVLQNQKKVEFKIDIVVLAFQKASGGGGSIYQELTDLKTAFERLCRHCPKDWTFFQGNCYFMSNSQRNWHDSVTACQEVRAQLVVIKTAEEQNFLQLQTSRSNRFSWMGLSDLNQEGTWQWVDGSPLSPSFQRYWNSGEPNNSGNEDCAEFSGSGWNDNRCDVDNYWICKKPAACFRD

SEQ ID NO: 2248 - protein, 380 aa, Artificial Sequence [sequence omitted]

SEQ ID NO: 2249 - protein, 457 aa, Artificial Sequence
  source: /note="Description of Artificial Sequence: Synthetic Chimeric Antigen Receptor sequence"
MALPVTALLLPLALLLHAARPEVKLQESGPGLVAPSQSLSFTCTVSGFSLSRNSVHWVRQPPGKGLEWLGMIWGGGSTDYNSALKSRLNISKDSSKSQVFLKMNSLQTDDTAMYFCARNGGYDVFHYWGQGTTVTVSSGGGGSGGGGSGGGGSQAVVTQESALTTSPGETVTLTCRSSTGAVTTSNYANWVQEKPDHLFTGLIGGTNNRAPGVPARFSGSLIGDKAALTITGAQTEDEAIYFCALWYSNHLVFGGGTKLTVLGGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2250 - protein, 180 aa, Artificial Sequence; identical to SEQ ID NO: 1208
  source: /note="Description of Artificial Sequence: Synthetic Chimeric Antigen Receptor sequence"

SEQ ID NO: 2251 - protein, 457 aa, Artificial Sequence
  source: /note="Description of Artificial Sequence: Synthetic Chimeric Antigen Receptor sequence"
MALPVTALLLPLALLLHAARPEVQLVESGGGLVQPGGSLRLSCAASGFSLSRNSVHWVRQAPGKGLEWLGMIWGGGSTDYNSALKSRFTISRDNSKNTLYLQMNSLRAEDTAVYYCARNGGYDVFHYWGQGTTVTVSSGGGGSGGGGSGGGGSQAVVTQEPSLTVSPGGTVTLTCRSSTGAVTTSNYANWVQQKPGQAPRGLIGGTNNRAPWTPARFSGSLLGGKAALTLSGVQPEDEAEYYCALWYSNHLVFGGGTKLTVLGGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2252 - protein, 460 aa, Artificial Sequence
  source: /note="Description of Artificial Sequence: Synthetic Chimeric Antigen Receptor sequence"
MALPVTALLLPLALLLHAARPEVKLQESGPGLVAPSQSLSFTCTVSGFSLSRNSVHWVRQPPGKGLEWLGMIWGGGSTDYNSALKSRLNISKDSSKSQVFLKMNSLQTDDTAMYFCARNGGYDVFHYWGQGTTVTVSSGGGGSGGGGSGGGGSQAVVTQESALTTSPGETVTLTCRSSTGAVTTSNYANWVQEKPDHLFTGLIGGTNNRAPGVPARFSGSLIGDKAALTITGAQTEDEAIYFCALWYSNHLVFGGGTKLTVLGGLAVSTISSFFPPGYQIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2253 - protein, 460 aa, Artificial Sequence
  source: /note="Description of Artificial Sequence: Synthetic Chimeric Antigen Receptor sequence"
MALPVTALLLPLALLLHAARPEVQLVESGGGLVQPGGSLRLSCAASGFSLSRNSVHWVRQAPGKGLEWLGMIWGGGSTDYNSALKSRFTISRDNSKNTLYLQMNSLRAEDTAVYYCARNGGYDVFHYWGQGTTVTVSSGGGGSGGGGSGGGGSQAVVTQEPSLTVSPGGTVTLTCRSSTGAVTTSNYANWVQQKPGQAPRGLIGGTNNRAPWTPARFSGSLLGGKAALTLSGVQPEDEAEYYCALWYSNHLVFGGGTKLTVLGGLAVSTISSFFPPGYQIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2254 - protein, 486 aa, Artificial Sequence
  source: /note="Description of Artificial Sequence: Synthetic Chimeric Antigen Receptor sequence"
MALPVTALLLPLALLLHAARPEVKLQESGPGLVAPSQSLSFTCTVSGFSLSRNSVHWVRQPPGKGLEWLGMIWGGGSTDYNSALKSRLNISKDSSKSQVFLKMNSLQTDDTAMYFCARNGGYDVFHYWGQGTTVTVSSGGGGSGGGGSGGGGSQAVVTQESALTTSPGETVTLTCRSSTGAVTTSNYANWVQEKPDHLFTGLIGGTNNRAPGVPARFSGSLIGDKAALTITGAQTEDEAIYFCALWYSNHLVFGGGTKLTVLGTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2255 - protein, 486 aa, Artificial Sequence
  source: /note="Description of Artificial Sequence: Synthetic Chimeric Antigen Receptor sequence"
MALPVTALLLPLALLLHAARPEVQLVESGGGLVQPGGSLRLSCAASGFSLSRNSVHWVRQAPGKGLEWLGMIWGGGSTDYNSALKSRFTISRDNSKNTLYLQMNSLRAEDTAVYYCARNGGYDVFHYWGQGTTVTVSSGGGGSGGGGSGGGGSQAVVTQEPSLTVSPGGTVTLTCRSSTGAVTTSNYANWVQQKPGQAPRGLIGGTNNRAPWTPARFSGSLLGGKAALTLSGVQPEDEAEYYCALWYSNHLVFGGGTKLTVLGTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2256 - protein, 489 aa, Artificial Sequence
  source: /note="Description of Artificial Sequence: Synthetic Chimeric Antigen Receptor sequence"
MALPVTALLLPLALLLHAARPEVKLQESGPGLVAPSQSLSFTCTVSGFSLSRNSVHWVRQPPGKGLEWLGMIWGGGSTDYNSALKSRLNISKDSSKSQVFLKMNSLQTDDTAMYFCARNGGYDVFHYWGQGTTVTVSSGGGGSGGGGSGGGGSQAVVTQESALTTSPGETVTLTCRSSTGAVTTSNYANWVQEKPDHLFTGLIGGTNNRAPGVPARFSGSLIGDKAALTITGAQTEDEAIYFCALWYSNHLVFGGGTKLTVLGTTTPAPRPPTPAPTIASQPLSLRPEACRPAAGGAVHTRGLDFACDIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2257 - protein, 489 aa, Artificial Sequence
  source: /note="Description of Artificial Sequence: Synthetic Chimeric Antigen Receptor sequence"
MALPVTALLLPLALLLHAARPEVQLVESGGGLVQPGGSLRLSCAASGFSLSRNSVHWVRQAPGKGLEWLGMIWGGGSTDYNSALKSRFTISRDNSKNTLYLQMNSLRAEDTAVYYCARNGGYDVFHYWGQGTTVTVSSGGGGSGGGGSGGGGSQAVVTQEPSLTVSPGGTVTLTCRSSTGAVTTSNYANWVQQKPGQAPRGLIGGTNNRAPWTPARFSGSLLGGKAALTLSGVQPEDEAEYYCALWYSNHLVFGGGTKLTVLGTTTPAPRPPTPAPTIASQPLSLRPEACRPAAGGAVHTRGLDFACDIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2258 - protein, 672 aa, Artificial Sequence
  source: /note="Description of Artificial Sequence: Synthetic Chimeric Antigen Receptor sequence"
MALPVTALLLPLALLLHAARPEVKLQESGPGLVAPSQSLSFTCTVSGFSLSRNSVHWVRQPPGKGLEWLGMIWGGGSTDYNSALKSRLNISKDSSKSQVFLKMNSLQTDDTAMYFCARNGGYDVFHYWGQGTTVTVSSGGGGSGGGGSGGGGSQAVVTQESALTTSPGETVTLTCRSSTGAVTTSNYANWVQEKPDHLFTGLIGGTNNRAPGVPARFSGSLIGDKAALTITGAQTEDEAIYFCALWYSNHLVFGGGTKLTVLGEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2259 - protein, 672 aa, Artificial Sequence
  source: /note="Description of Artificial Sequence: Synthetic Chimeric Antigen Receptor sequence"
MALPVTALLLPLALLLHAARPEVQLVESGGGLVQPGGSLRLSCAASGFSLSRNSVHWVRQAPGKGLEWLGMIWGGGSTDYNSALKSRFTISRDNSKNTLYLQMNSLRAEDTAVYYCARNGGYDVFHYWGQGTTVTVSSGGGGSGGGGSGGGGSQAVVTQEPSLTVSPGGTVTLTCRSSTGAVTTSNYANWVQQKPGQAPRGLIGGTNNRAPWTPARFSGSLLGGKAALTLSGVQPEDEAEYYCALWYSNHLVFGGGTKLTVLGEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2260 - protein, 675 aa, Artificial Sequence
  source: /note="Description of Artificial Sequence: Synthetic Chimeric Antigen Receptor sequence"
MALPVTALLLPLALLLHAARPEVKLQESGPGLVAPSQSLSFTCTVSGFSLSRNSVHWVRQPPGKGLEWLGMIWGGGSTDYNSALKSRLNISKDSSKSQVFLKMNSLQTDDTAMYFCARNGGYDVFHYWGQGTTVTVSSGGGGSGGGGSGGGGSQAVVTQESALTTSPGETVTLTCRSSTGAVTTSNYANWVQEKPDHLFTGLIGGTNNRAPGVPARFSGSLIGDKAALTITGAQTEDEAIYFCALWYSNHLVFGGGTKLTVLGEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2261 - protein, 675 aa, Artificial Sequence
  source: /note="Description of Artificial Sequence: Synthetic Chimeric Antigen Receptor sequence"
MALPVTALLLPLALLLHAARPEVQLVESGGGLVQPGGSLRLSCAASGFSLSRNSVHWVRQAPGKGLEWLGMIWGGGSTDYNSALKSRFTISRDNSKNTLYLQMNSLRAEDTAVYYCARNGGYDVFHYWGQGTTVTVSSGGGGSGGGGSGGGGSQAVVTQEPSLTVSPGGTVTLTCRSSTGAVTTSNYANWVQQKPGQAPRGLIGGTNNRAPWTPARFSGSLLGGKAALTLSGVQPEDEAEYYCALWYSNHLVFGGGTKLTVLGEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2262 - protein, 606 aa, Artificial Sequence
  source: /note="Description of Artificial Sequence: Synthetic Chimeric Antigen Receptor sequence"
MHPLLNPLLLALGLMALLLTTVIALTCLGGFASPGPVPPSTALRKLIEELVNITQNQKAPLCNGSMVWSINLTAGMYCAALESLINVSGCSAIEKTQRMLSGFCPHKVSAGQFSSLHVRDTKIEVAQFVKDLLLHLKKLFKEGQFNPRKPTTTPAPRPPTPAPTIASQPLSLRPEACRPAAGGAVHTRGLDFAQLLCYLLDGILFIYGVILTALFLRVVTFWVRSKRSRLLHSDYMNMTPRRPGPTRKHYQPYAPPRDFAAYRSTRKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRQPAAAEGRGSLLTCGDVEENPGPMDKDCEMKRTTLDSPLGKLELSGCEQGLHEIKLLGKGTSAADAVEVPAPAAVLGGPEPLMQCTAWLNAYFHQPEAIEEFPVPALHHPVFQQESFTRQVLWKLLKVVKFGEVISYQQLAALAGNPKAARAVGGAMRGNPVKILIPCHRVVCSSGAVGNYSGGLAVKEWLLAHEGHRLGKPGLGGSSGLAGAWLKGAGATSGSPPAGRN

SEQ ID NO: 2263 - protein, 606 aa, Artificial Sequence
  source: /note="Description of Artificial Sequence: Synthetic Chimeric Antigen Receptor sequence"
MHPLLNPLLLALGLMALLLTTVIALTCLGGFASPGPVPPSTALRYLIEELVNITQNQKAPLCNGSMVWSINLTAGMYCAALESLINVSGCSAIEKTQRMLSGFCPHKVSAGQFSSLHVRDTKIEVAQFVKDLLLHLKKLFREGQFNPRKPTTTPAPRPPTPAPTIASQPLSLRPEACRPAAGGAVHTRGLDFAQLLCYLLDGILFIYGVILTALFLRVVTFWVRSKRSRLLHSDYMNMTPRRPGPTRKHYQPYAPPRDFAAYRSTRKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRQPAAAEGRGSLLTCGDVEENPGPMDKDCEMKRTTLDSPLGKLELSGCEQGLHEIKLLGKGTSAADAVEVPAPAAVLGGPEPLMQCTAWLNAYFHQPEAIEEFPVPALHHPVFQQESFTRQVLWKLLKVVKFGEVISYQQLAALAGNPKAARAVGGAMRGNPVKILIPCHRVVCSSGAVGNYSGGLAVKEWLLAHEGHRLGKPGLGGSSGLAGAWLKGAGATSGSPPAGRN

SEQ ID NO: 2264 - protein, 889 aa, Artificial Sequence
  source: /note="Description of Artificial Sequence: Synthetic Chimeric Antigen Receptor sequence"
MLLLVTSLLLCELPHPAFLLIPGPVPPSTALRYLIEELVNITQNQKAPLCNGSMVWSINLTAGMYCAALESLINVSGCSAIEKTQRMLSGFCPHKVSAGQFSSLHVRDTKIEVAQFVKDLLLHLKKLFREGRFNESKYGPPCPPCPAPEFEGGPSVFLFPPKPKDTLMISRTPEVTCVVVDVSQEDPEVQFNWYVDGVEVHNAKTKPREEQFQSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKMALIVLGGVAGLLLFIGLGIFFKRGRKKLLYIFKQPFMRPVQTTQEEDGCSCRFPEEEEGGCELGGGRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRLEGGGEGRGSLLTCGDVEENPGPRMPPPRLLFFLLFLTPMEVRPEEPLVVKVEEGDNAVLQCLKGTSDGPTQQLTWSRESPLKPFLKLSLGLPGLGIHMRPLAIWLFIFNVSQQMGGFYLCQPGPPSEKAWQPGWTVNVEGSGELFRWNVSDLGGLGCGLKNRSSEGPSSPSGKLMSPKLYVWAKDRPEIWEGEPPCVPPRDSLNQSLSQDLTMAPGSTLWLSCGVPPDSVSRGPLSWTHVHPKGPKSLLSLELKDDRPARDMWVMETGLLLPRATAQDAGKYYCHRGNLTMSFHLEITARPVLWHWLLRTGGWKVSAVTLAYLIFCLCSLVGILHLQRALVLRRKR

SEQ ID NO: 2265 - protein, 200 aa, Artificial Sequence
  source: /note="Description of Artificial Sequence: Synthetic Chimeric Antigen Receptor sequence"
DLEPKSCDKTHTCPPCPDPKFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2266 - protein, 419 aa, Artificial Sequence
  source: /note="Description of Artificial Sequence: Synthetic Chimeric Antigen Receptor sequence"
DPAEPKSPDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKKDPKFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2267 - protein, 467 aa, Artificial Sequence
  source: /note="Description of Artificial Sequence: Synthetic Chimeric Antigen Receptor sequence"
MDWIWRILFLVGAATGAHSQVQLQQPGAELVRPGASVKLSCKASGYTFSNYLMNWVKQRPEQDLDWIGRIDPYDGDIDYNQNFKDKAILTVDKSSSTAYMQLSSLTSEDSAVYYCARGYGTAYGVDYWGQGTSVTVSSAKTTPPKLEEGEFSEARVDIVLTQSPASLAVSLGQRATISCRASESVDNYGISFMNWFQQKPGQPPKLLIYAASRQGSGVPARFSGSGSGTDFSLNIHPMEEDDTAMYFCQQSKEVPWTFGGGTKLEIKDLEPKSCDKTHTCPPCPDPKFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2268 - protein, 487 aa, Artificial Sequence
  source: /note="Description of Artificial Sequence: Synthetic Chimeric Antigen Receptor sequence"
MVLLVTSLLLCELPHPAFLLIPDIQQVQLQQSGPELEKPGASVKISCKASGYSFTGYTMNWVKQSHGKSLEWIGLITPYNGASSYNQKFRGKATLTVDKSSSTAYMDLLSLTSEDSAVYFCARGGYDGRGFDYWGQGTTVTVSSGGGGSGGGGSGGGGSDIELTQSPAIMSASPGEKVTMTCSASSSVSYMHWYQQKSGTSPKRWIYDTSKLASGVPGRFSGSGSGNSYSLTISSVEAEDDATYYCQQWSGYPLTFGAGTKLEIKAAAIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2269 - protein, 688 aa, Artificial Sequence
  source: /note="Description of Artificial Sequence: Synthetic Chimeric Antigen Receptor sequence"
MDWIWRILFLVGAATGAHSQVQLQQPGAELVRPGASVKLSCKASGYTFSNYLMNWVKQRPEQDLDWIGRIDPYDGDIDYNQNFKDKAILTVDKSSSTAYMQLSSLTSEDSAVYYCARGYGTAYGVDYWGQGTSVTVSSAKTTPPKLEEGEFSEARVDIVLTQSPASLAVSLGQRATISCRASESVDNYGISFMNWFQQKPGQPPKLLIYAASRQGSGVPARFSGSGSGTDFSLNIHPMEEDDTAMYFCQQSKEVPWTFGGGTKLEIKAEDPAEPKSPDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKKDPKFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2270 - protein, 340 aa, Artificial Sequence
  source: /note="Description of Artificial Sequence: Synthetic Chimeric Antigen Receptor sequence"
GPVPPSTALRYLIEELVNITQNQKAPLCNGSMVWSINLTAGMYCAALESLINVSGCSAIEKTQRMLSGFCPHKVSAGQFSSLHVRDTKIEVAQFVKDLLLHLKKLFREGRFNAKPTTTPAPRPPTPAPTIASQPLSLRPEACRPAAGGAVHTRGLDFACDIYIWAPLAGTCGVLLLSLVITLYKRGRKKLLYIFKQPFMRPVQTTQEEDGCSCRFPEEEEGGCELGGGRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2271 - protein, 341 aa, Artificial Sequence
  source: /note="Description of Artificial Sequence: Synthetic Chimeric Antigen Receptor sequence"
GPVPPSTALRYLIEELVNITQNQKAPLCNGSMVWSINLTAGMYCAALESLINVSGCSAIEKTQRMLSGFCPHKVSAGQFSSLHVRDTKIEVAQFVKDLLLHLKKLFREGRFNAKPTTTPAPRPPTPAPTIASQPLSLRPEACRPAAGGAVHTRGLDFACDIYIWAPLAGTCGVLLLSLVITGGGKRGRKKLLYIFKQPFMRPVQTTQEEDGCSCRFPEEEEGGCELGGGRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2272 - protein, 351 aa, Artificial Sequence
  source: /note="Description of Artificial Sequence: Synthetic Chimeric Antigen Receptor sequence"
GPVPPSTALRYLIEELVNITQNQKAPLCNGSMVWSINLTAGMYCAALESLINVSGCSAIEKTQRMLSGFCPHKVSAGQFSSLHVRDTKIEVAQFVKDLLLHLKKLFREGRFNGGGSSGGGSGMFWVLVVVGGVLACYSLLVTVAFIIFWVRSKRSRGGHSDYMNMTPRRPGPTRKHYQPYAPPRDFAAYRSGGGKRGRKKLLYIFKQPFMRPVQTTQEEDGCSCRFPEEEEGGCELGGGRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2273 - protein, 362 aa, Artificial Sequence
  source: /note="Description of Artificial Sequence: Synthetic Chimeric Antigen Receptor sequence"
MLLLVTSLLLCELPHPAFLLIPGPVPPSTALRYLIEELVNITQNQKAPLCNGSMVWSINLTAGMYCAALESLINVSGCSAIEKTQRMLSGFCPHKVSAGQFSSLHVRDTKIEVAQFVKDLLLHLKKLFREGRFNAKPTTTPAPRPPTPAPTIASQPLSLRPEACRPAAGGAVHTRGLDFACDIYIWAPLAGTCGVLLLSLVITLYKRGRKKLLYIFKQPFMRPVQTTQEEDGCSCRFPEEEEGGCELGGGRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2274 - protein, 363 aa, Artificial Sequence
  source: /note="Description of Artificial Sequence: Synthetic Chimeric Antigen Receptor sequence"
GPVPPSTALRYLIEELVNITQNQKAPLCNGSMVWSINLTAGMYCAALESLINVSGCSAIEKTQRMLSGFCPHKVSAGQFSSLHVRDTKIEVAQFVKDLLLHLKKLFREGRFNESKYGPPCPPCPGGGSSGGGSGMFWVLVVVGGVLACYSLLVTVAFIIFWVRSKRSRGGHSDYMNMTPRRPGPTRKHYQPYAPPRDFAAYRSGGGKRGRKKLLYIFKQPFMRPVQTTQEEDGCSCRFPEEEEGGCELGGGRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2275 - protein, 363 aa, Artificial Sequence
  source: /note="Description of Artificial Sequence: Synthetic Chimeric Antigen Receptor sequence"
MLLLVTSLLLCELPHPAFLLIPGPVPPSTALRYLIEELVNITQNQKAPLCNGSMVWSINLTAGMYCAALESLINVSGCSAIEKTQRMLSGFCPHKVSAGQFSSLHVRDTKIEVAQFVKDLLLHLKKLFREGRFNAKPTTTPAPRPPTPAPTIASQPLSLRPEACRPAAGGAVHTRGLDFACDIYIWAPLAGTCGVLLLSLVITGGGKRGRKKLLYIFKQPFMRPVQTTQEEDGCSCRFPEEEEGGCELGGGRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2276 - protein, 373 aa, Artificial Sequence
  source: /note="Description of Artificial Sequence: Synthetic Chimeric Antigen Receptor sequence"
MLLLVTSLLLCELPHPAFLLIPGPVPPSTALRYLIEELVNITQNQKAPLCNGSMVWSINLTAGMYCAALESLINVSGCSAIEKTQRMLSGFCPHKVSAGQFSSLHVRDTKIEVAQFVKDLLLHLKKLFREGRFNGGGSSGGGSGMFWVLVVVGGVLACYSLLVTVAFIIFWVRSKRSRGGHSDYMNMTPRRPGPTRKHYQPYAPPRDFAAYRSGGGKRGRKKLLYIFKQPFMRPVQTTQEEDGCSCRFPEEEEGGCELGGGRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2277 - protein, 385 aa, Artificial Sequence
  source: /note="Description of Artificial Sequence: Synthetic Chimeric Antigen Receptor sequence"
MLLLVTSLLLCELPHPAFLLIPGPVPPSTALRYLIEELVNITQNQKAPLCNGSMVWSINLTAGMYCAALESLINVSGCSAIEKTQRMLSGFCPHKVSAGQFSSLHVRDTKIEVAQFVKDLLLHLKKLFREGRFNESKYGPPCPPCPGGGSSGGGSGMFWVLVVVGGVLACYSLLVTVAFIIFWVRSKRSRGGHSDYMNMTPRRPGPTRKHYQPYAPPRDFAAYRSGGGKRGRKKLLYIFKQPFMRPVQTTQEEDGCSCRFPEEEEGGCELGGGRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2278 - protein, 388 aa, Artificial Sequence
  source: /note="Description of Artificial Sequence: Synthetic Chimeric Antigen Receptor sequence"
GPVPPSTALRYLIEELVNITQNQKAPLCNGSMVWSINLTAGMYCAALESLINVSGCSAIEKTQRMLSGFCPHKVSAGQFSSLHVRDTKIEVAQFVKDLLLHLKKLFREGRFNAKPTTTPAPRPPTPAPTIASQPLSLRPEACRPAAGGAVHTRGLDFACDFWVLVVVGGVLACYSLLVTVAFIIFWVRSKRSRGGHSDYMNMTPRRPGPTRKHYQPYAPPRDFAAYRSGGGKRGRKKLLYIFKQPFMRPVQTTQEEDGCSCRFPEEEEGGCELGGGRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2279 - protein, 410 aa, Artificial Sequence
  source: /note="Description of Artificial Sequence: Synthetic Chimeric Antigen Receptor sequence"
MLLLVTSLLLCELPHPAFLLIPGPVPPSTALRYLIEELVNITQNQKAPLCNGSMVWSINLTAGMYCAALESLINVSGCSAIEKTQRMLSGFCPHKVSAGQFSSLHVRDTKIEVAQFVKDLLLHLKKLFREGRFNAKPTTTPAPRPPTPAPTIASQPLSLRPEACRPAAGGAVHTRGLDFACDFWVLVVVGGVLACYSLLVTVAFIIFWVRSKRSRGGHSDYMNMTPRRPGPTRKHYQPYAPPRDFAAYRSGGGKRGRKKLLYIFKQPFMRPVQTTQEEDGCSCRFPEEEEGGCELGGGRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2280 - protein, 420 aa, Artificial Sequence
  source: /note="Description of Artificial Sequence: Synthetic Chimeric Antigen Receptor sequence"
GPVPPSTALRYLIEELVNITQNQKAPLCNGSMVWSINLTAGMYCAALESLINVSGCSAIEKTQRMLSGFCPHKVSAGQFSSLHVRDTKIEVAQFVKDLLLHLKKLFREGRFNESKYGPPCPPCPGGGSSGGGSGGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKMALIVLGGVAGLLLFIGLGIFFKRGRKKLLYIFKQPFMRPVQTTQEEDGCSCRFPEEEEGGCELGGGRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2281 - protein, 442 aa, Artificial Sequence
  source: /note="Description of Artificial Sequence: Synthetic Chimeric Antigen Receptor sequence"
MLLLVTSLLLCELPHPAFLLIPGPVPPSTALRYLIEELVNITQNQKAPLCNGSMVWSINLTAGMYCAALESLINVSGCSAIEKTQRMLSGFCPHKVSAGQFSSLHVRDTKIEVAQFVKDLLLHLKKLFREGRFNESKYGPPCPPCPGGGSSGGGSGGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKMALIVLGGVAGLLLFIGLGIFFKRGRKKLLYIFKQPFMRPVQTTQEEDGCSCRFPEEEEGGCELGGGRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2282 - protein, 470 aa, Artificial Sequence
  source: /note="Description of Artificial Sequence: Synthetic Chimeric Antigen Receptor sequence"
GPVPPSTALRYLIEELVNITQNQKAPLCNGSMVWSINLTAGMYCAALESLINVSGCSAIEKTQRMLSGFCPHKVSAGQFSSLHVRDTKIEVAQFVKDLLLHLKKLFREGRFNESKYGPPCPPCPGGGSSGGGSGGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKMFWVLVVVGGVLACYSLLVTVAFIIFWVRSKRSRGGHSDYMNMTPRRPGPTRKHYQPYAPPRDFAAYRSGGGKRGRKKLLYIFKQPFMRPVQTTQEEDGCSCRFPEEEEGGCELGGGRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2283 - protein, 492 aa, Artificial Sequence
  source: /note="Description of Artificial Sequence: Synthetic Chimeric Antigen Receptor sequence"
MLLLVTSLLLCELPHPAFLLIPGPVPPSTALRYLIEELVNITQNQKAPLCNGSMVWSINLTAGMYCAALESLINVSGCSAIEKTQRMLSGFCPHKVSAGQFSSLHVRDTKIEVAQFVKDLLLHLKKLFREGRFNESKYGPPCPPCPGGGSSGGGSGGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKMFWVLVVVGGVLACYSLLVTVAFIIFWVRSKRSRGGHSDYMNMTPRRPGPTRKHYQPYAPPRDFAAYRSGGGKRGRKKLLYIFKQPFMRPVQTTQEEDGCSCRFPEEEEGGCELGGGRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2284 - protein, 519 aa, Artificial Sequence
  source: /note="Description of Artificial Sequence: Synthetic Chimeric Antigen Receptor sequence"
GPVPPSTALRYLIEELVNITQNQKAPLCNGSMVWSINLTAGMYCAALESLINVSGCSAIEKTQRMLSGFCPHKVSAGQFSSLHVRDTKIEVAQFVKDLLLHLKKLFREGRFNESKYGPPCPPCPAPEFEGGPSVFLFPPKPKDTLMISRTPEVTCVVVDVSQEDPEVQFNWYVDGVEVHNAKTKPREEQFQSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKIYIWAPLAGTCGVLLLSLVITKRGRKKLLYIFKQPFMRPVQTTQEEDGCSCRFPEEEEGGCELGGGRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2285 - protein, 541 aa, Artificial Sequence
  source: /note="Description of Artificial Sequence: Synthetic Chimeric Antigen Receptor sequence"
MLLLVTSLLLCELPHPAFLLIPGPVPPSTALRYLIEELVNITQNQKAPLCNGSMVWSINLTAGMYCAALESLINVSGCSAIEKTQRMLSGFCPHKVSAGQFSSLHVRDTKIEVAQFVKDLLLHLKKLFREGRFNESKYGPPCPPCPAPEFEGGPSVFLFPPKPKDTLMISRTPEVTCVVVDVSQEDPEVQFNWYVDGVEVHNAKTKPREEQFQSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKIYIWAPLAGTCGVLLLSLVITKRGRKKLLYIFKQPFMRPVQTTQEEDGCSCRFPEEEEGGCELGGGRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2286 - protein, 570 aa, Artificial Sequence
  source: /note="Description of Artificial Sequence: Synthetic Chimeric Antigen Receptor sequence"
GPVPPSTALRYLIEELVNITQNQKAPLCNGSMVWSINLTAGMYCAALESLINVSGCSAIEKTQRMLSGFCPHKVSAGQFSSLHVRDTKIEVAQFVKDLLLHLKKLFREGRFNESKYGPPCPPCPAPEFEGGPSVFLFPPKPKDTLMISRTPEVTCVVVDVSQEDPEVQFNWYVDGVEVHNAKTKPREEQFQSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKMFWVLVVVGGVLACYSLLVTVAFIIFWVRSKRSRGGHSDYMNMTPRRPGPTRKHYQPYAPPRDFAAYRSGGGKRGRKKLLYIFKQPFMRPVQTTQEEDGCSCRFPEEEEGGCELGGGRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2287 - protein, 592 aa, Artificial Sequence
  source: /note="Description of Artificial Sequence: Synthetic Chimeric Antigen Receptor sequence"
MLLLVTSLLLCELPHPAFLLIPGPVPPSTALRYLIEELVNITQNQKAPLCNGSMVWSINLTAGMYCAALESLINVSGCSAIEKTQRMLSGFCPHKVSAGQFSSLHVRDTKIEVAQFVKDLLLHLKKLFREGRFNESKYGPPCPPCPAPEFEGGPSVFLFPPKPKDTLMISRTPEVTCVVVDVSQEDPEVQFNWYVDGVEVHNAKTKPREEQFQSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKMFWVLVVVGGVLACYSLLVTVAFIIFWVRSKRSRGGHSDYMNMTPRRPGPTRKHYQPYAPPRDFAAYRSGGGKRGRKKLLYIFKQPFMRPVQTTQEEDGCSCRFPEEEEGGCELGGGRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2288 - protein, 688 aa, Artificial Sequence
  source: /note="Description of Artificial Sequence: Synthetic Chimeric Antigen Receptor sequence"
MEFGLSWLFLVAILKGVQCSRDIVMTQSQKFMSTSVGDRVSVTCKASQNVGTNVAWYQQKPGQSPKALIYSTSYRYSGVPDRFTGSGSGTDFTLTISNVQSEDLAEYFCQQYNSYPYTFGGGTKLEIKGGGGSGGGGSGGGGSEVQLQQSGAELVKPGASVKLSCTASGFNIKDTYMHWVKQRPEQGLEWIGRIDPANGNTKYDPKFQGKATIIADTSSNTAYLQLSSLTSEDTAVYYCARGVYHDYDGDYWGQGTTLTVSSYVTVSSQDPAEPKSPDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKKDPKFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2289 - protein, 488 aa, Artificial Sequence
  source: /note="Description of Artificial Sequence: Synthetic Chimeric Antigen Receptor sequence"
MALPVTALLLPLALLLHAARPGSQVQLQQSGPELEKPGASVKISCKASGYSFTGYTMNWVKQSHGKSLEWIGLITPYNGASSYNQKFRGKATLTVDKSSSTAYMDLLSLTSEDSAVYFCARGGYDGRGFDYWGQGTTVTVSSGGGGSGGGGSSGGGSDIELTQSPAIMSASPGEKVTMTCSASSSVSYMHWYQQKSGTSPKRWIYDTSKLASGVPGRFSGSGSGNSYSLTISSVEAEDDATYYCQQWSKHPLTYGAGTKLEIKASTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2290 - protein, 480 aa, Artificial Sequence
  source: /note="Description of Artificial Sequence: Synthetic polypeptide"
MALPVTALLLPLALLLHAARPQVQLVQSGGGLVQPGRSLRLSCAASGFTFDDYAMHWVRQAPGKGLEWVSGISWNSGSIGYADSVKGRFTISRDNAKNSLYLQMNSLRAEDTAVYYCAKDGSSSWSWGYFDYWGQGTLVTVSSGGGGSGGGGSGGGGSSSELTQDPAVSVALGQTVRTTCQGDALRSYYASWYQQKPGQAPMLVIYGKNNRPSGIPDRFSGSDSGDTASLTITGAQAEDEADYYCNSRDSSGYPVFGTGTKVTVLTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDAL

SEQ ID NO: 2291 - protein, 445 aa, Artificial Sequence
  source: /note="Description of Artificial Sequence: Synthetic Chimeric Antigen Receptor sequence"
MALPVTALLLPLALLLHAARPEVQLVESGGGLVKPGGSLRLSCAASGFTFSRYGMSWVRQAPGKRLEWVSTISGGGTYIYYPDSVKGRFTISRDNAKNTLYLQMNSLRAEDTAVYYCTRDNYGRNYDYGMDYWGQGTLVTVSSGGGGSGGGGSGGGGSEIVLTQSPATLSLSPGERATLTCSATSSVSYIHWYQQRPGQSPRLLIYSTSNLASGIPARFSGSGSGSDYTLTISSLEPEDFAVYYCQQRSSSPFTFGSGTKVEIKTTTPAPRPPTPAPTIASQPLSLRPEACRPAAGGAVHTRGLDFACDIYIWAPLAGTCGVLLLSLVITLYCRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2292 - protein, 464 aa, Artificial Sequence
  source: /note="Description of Artificial Sequence: Synthetic Chimeric Antigen Receptor sequence"
MALPVTALLLPLALLLHAARPGSQVQLQQSGPGLVTPSQTLSLTCAISGDSVSSNSATWNWIRQSPSRGLEWLGRTYYRSKWYNDYAVSVKSRMSINPDTSKNQFSLQLNSVTPEDTAVYYCARGMMTYYYGMDVWGQGTTVTVSSGILGSGGGGSGGGGSGGGGSQPVLTQSSSLSASPGASASLTCTLRSGINVGPYRIYWYQQKPGSPPQYLLNYKSDSDKQQGSGVPSRFSGSKDASANAGVLLISGLRSEDEADYYCMIWHSSAAVFGGGTQLTVLSASTTTPAPRPPTPAPTIASRPLSLRPEACRPAAGGAVHTRGLDFACDIYIWAPLAGTCGVLLLSLVITLYCRVKFSRSADAPAYQQGQNQLYNELNLGRREEYDVLDKRRGRDPEMGGKPRRKNPQEGLYNELQKDKMAEAYSEIGMKGERRGKGHDGLYQGLSTARKDTYDALHMQALPPT

SEQ ID NO: 2293 - protein, 487 aa, Artificial Sequence
  source: /note="Description of Artificial Sequence: Synthetic Chimeric Antigen Receptor sequence"
MVLLVTSLLLCELPHPAFLLIPDIQQVQLQQSGPELEKPGASVKISCKASGYSFTGYTMNWVKQSHGKSLEWIGLITPYNGASSYNQKFRGKATLTVDKSSSTAYMDLLSLTSEDSAVYFCARGGYDGRGFDYWGQGTTVTVSSGGGGSGGGGSSGGGSDIELTQSPAIMSASPGEKVTMTCSASSSVSYMHWYQQKSGTSPKRWIYDTSKLASGVPGRFSGSGSGNSYSLTISSVEAEDDATYYCQQWSKHPLTFGAGTKLEIKAAAIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2294 - protein, 490 aa, Artificial Sequence
  source: /note="Description of Artificial Sequence: Synthetic Chimeric Antigen Receptor sequence"
MVLLVTSLLLCELPHPAFLLIPDIQAQVQLVQSGAEVKRPGASVQVSCRASGYSINTYYMQWVRQAPGAGLEWMGVINPSGVTSYAQKFQGRVTLTNDTSTNTVYMQLNSLTSADTAVYYCARWALWGDFGMDVWGKGTLVTVSSGGGGSGGGGSGGGGSDIQMTQSPSTLSASIGDRVTITCRASEGIYHWLAWYQQKPGKAPKLLIYKASSLASGAPSRFSGSGSGTDFTLTISSLQPDDFATYYCQQYSNYPLTFGGGTKLEIKRAAAIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2295 - protein, 507 aa, Artificial Sequence
  source: /note="Description of Artificial Sequence: Synthetic Chimeric Antigen Receptor sequence"
MALPVTALLLPLALLLHAARPGSQVQLQQSGPGLVTPSQTLSLTCAISGDSVSSNSATWNWIRQSPSRGLEWLGRTYYRSKWYNDYAVSVKSRMSINPDTSKNQFSLQLNSVTPEDTAVYYCARGMMTYYYGMDVWGQGTTVTVSSGILGSGGGGSGGGGSGGGGSQPVLTQSSSLSASPGASASLTCTLRSGINVGPYRIYWYQQKPGSPPQYLLNYKSDSDKQQGSGVPSRFSGSKDASANAGVLLISGLRSEDEADYYCMIWHSSAAVFGGGTQLTVLSASTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2296 - protein, 511 aa, Artificial Sequence
  source: /note="Description of Artificial Sequence: Synthetic Chimeric Antigen Receptor sequence"
MALPVTALLLPLALLLHAARPGSQVQLQQSGPGLVTPSQTLSLTCAISGDSVSSNSATWNWIRQSPSRGLEWLGRTYYRSKWYNDYAVSVKSRMSINPDTSKNQFSLQLNSVTPEDTAVYYCARGMMTYYYGMDVWGQGTTVTVSSGILGSGGGGSGGGGSGGGGSQPVLTQSSSLSASPGASASLTCTLRSGINVGPYRIYWYQQKPGSPPQYLLNYKSDSDKQQGSGVPSRFSGSKDASANAGVLLISGLRSEDEADYYCMIWHSSAAVFGGGTQLTVLSASTTTPAPRPPTPAPTIASQPLSLRPEACRPAAGGAVHTRGLDFACDFWVLVVVGGVLACYSLLVTVAFIIFWVRSKRSRLLHSDYMNMTPRRPGPTRKHYQPYAPPRDFAAYRSIDRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2297 - protein, 551 aa, Artificial Sequence
  source: /note="Description of Artificial Sequence: Synthetic Chimeric Antigen Receptor sequence"
MVLLVTSLLLCELPHPAFLLIPDIQQVQLQQSGPELEKPGASVKISCKASGYSFTGYTMNWVKQSHGKSLEWIGLITPYNGASSYNQKFRGKATLTVDKSSSTAYMDLLSLTSEDSAVYFCARGGYDGRGFDYWGQGTTVTVSSGGGGSGGGGSGGGGSDIELTQSPAIMSASPGEKVTMTCSASSSVSYMHWYQQKSGTSPKRWIYDTSKLASGVPGRFSGSGSGNSYSLTISSVEAEDDATYYCQQWSGYPLTFGAGTKLEIKAAAFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2298 - protein, 551 aa, Artificial Sequence
  source: /note="Description of Artificial Sequence: Synthetic Chimeric Antigen Receptor sequence"
MVLLVTSLLLCELPHPAFLLIPDIQQVQLQQSGPELEKPGASVKISCKASGYSFTGYTMNWVKQSHGKSLEWIGLITPYNGASSYNQKFRGKATLTVDKSSSTAYMDLLSLTSEDSAVYFCARGGYDGRGFDYWGQGTTVTVSSGGGGSGGGGSSGGGSDIELTQSPAIMSASPGEKVTMTCSASSSVSYMHWYQQKSGTSPKRWIYDTSKLASGVPGRFSGSGSGNSYSLTISSVEAEDDATYYCQQWSKHPLTFGAGTKLEIKAAAFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2299 - protein, 554 aa, Artificial Sequence
  source: /note="Description of Artificial Sequence: Synthetic Chimeric Antigen Receptor sequence"
MVLLVTSLLLCELPHPAFLLIPDIQAQVQLVQSGAEVKRPGASVQVSCRASGYSINTYYMQWVRQAPGAGLEWMGVINPSGVTSYAQKFQGRVTLTNDTSTNTVYMQLNSLTSADTAVYYCARWALWGDFGMDVWGKGTLVTVSSGGGGSGGGGSGGGGSDIQMTQSPSTLSASIGDRVTITCRASEGIYHWLAWYQQKPGKAPKLLIYKASSLASGAPSRFSGSGSGTDFTLTISSLQPDDFATYYCQQYSNYPLTFGGGTKLEIKRAAAFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2300 - protein, 738 aa, Artificial Sequence
  source: /note="Description of Artificial Sequence: Synthetic Chimeric Antigen Receptor sequence"
MALPVTALLLPLALLLHAARPEVQLQQSGGERATPGASVKMSCKTSGYTFTNYWMHWVKQRPGQGLEWIGYINPSSGYTQYNQKFKDKATLTADKSSSTAYIQLSSLTSEDSAVYYCSTYYGDYLFPYWGQGTLVTVSAGGGGSGGGGSGGGGSDVLMTQTPLSLPVSLGDQASISCRSSQDIVYGNGNTYLEWYLQKPGQSPKLLIYKVSNRFSGVPDRFSGSGSGTDFTLKISRVEAEDLGVYYCFQGSHVPYTFGGGTKLEIKRAAAIEVEQKLISEEDLLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRARGAAAGAGGAGRMVSELIKENMHMKLYMEGTVNNHHFKCTSEGEGKPYEGTQTMRIKAVEGGPLPFAFDILATSFMYGSKTFINHTQGIPDFFKQSFPEGFTWERVTTYEDGGVLTATQDTSLQDGCLIYNVKIRGVNFPSNGPVMQKKTLGWEASTETLYPADGGLEGRADMALKLVGGGHLICNLKTTYRSKKPAKNLKMPGVYYVDRRLERIKEADKETYVEQHEVAVARYCDLPSKLGHR

SEQ ID NO: 2301 - protein, 451 aa, Artificial Sequence
  source: /note="Description of Artificial Sequence: Synthetic Chimeric Antigen Receptor sequence"
MALPVTALLLPLALLLHAARPEVQLVESGGGLVKPGGSLRLSCAASGFTFSGYAMSWVRQAPGKGLEWVSTISSGGTYIYYPDSVKGRFTISRDNAKNSLYLQMNSLRAEDTAVYYCARLGGDNYYEYFDVWGKGTTVTVSSGGGGSGGGGSGGGGSDIVLTQSPASLAVSPGQRATITCRASKSVSTSGYSYMHWYQQKPGQPPKLLIYLASNLESGVPARFSGSGSGTDFTLTINPVEANDTANYYCQHSRELPFTFGGGTKVEIKRTTTTPAPRPPTPAPTIASQPLSLRPEACRPAAGGAVHTRGLDFACDIYIWAPLAGTCGVLLLSLVITLYCRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2302 - protein, 482 aa, Artificial Sequence
  source: /note="Description of Artificial Sequence: Synthetic Chimeric Antigen Receptor sequence"
MALPVTALLLPLALLLHAARPEVQLVESGGGLVKPGGSLRLSCAASGFTFSRYGMSWVRQAPGKRLEWVSTISGGGTYIYYPDSVKGRFTISRDNAKNTLYLQMNSLRAEDTAVYYCTRDNYGRNYDYGMDYWGQGTLVTVSSGGGGSGGGGSGGGGSEIVLTQSPATLSLSPGERATLTCSATSSVSYIHWYQQRPGQSPRLLIYSTSNLASGIPARFSGSGSGSDYTLTISSLEPEDFAVYYCQQRSSSPFTFGSGTKVEIKTTTPAPRPPTPAPTIASQPLSLRPEACRPAAGGAVHTRGLDFACDIYIWAPLAGTCGVLLLSLVITLYCRRDQRLPPDAHKPPGGGSFRTPIQEEQADAHSTLAKIRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2303 - protein, 486 aa, Artificial Sequence
  source: /note="Description of Artificial Sequence: Synthetic Chimeric Antigen Receptor sequence"
MALPVTALLLPLALLLHAARPEVQLVESGGGLVKPGGSLRLSCAASGFTFSRYGMSWVRQAPGKRLEWVSTISGGGTYIYYPDSVKGRFTISRDNAKNTLYLQMNSLRAEDTAVYYCTRDNYGRNYDYGMDYWGQGTLVTVSSGGGGSGGGGSGGGGSEIVLTQSPATLSLSPGERATLTCSATSSVSYIHWYQQRPGQSPRLLIYSTSNLASGIPARFSGSGSGSDYTLTISSLEPEDFAVYYCQQRSSSPFTFGSGTKVEIKTTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2304 - protein, 487 aa, Artificial Sequence
  source: /note="Description of Artificial Sequence: Synthetic Chimeric Antigen Receptor sequence"
MALPVTALLLPLALLLHAARPEVQLVESGGGLVKPGGSLRLSCAASGFTFSRYGMSWVRQAPGKRLEWVSTISGGGTYIYYPDSVKGRFTISRDNAKNTLYLQMNSLRAEDTAVYYCTRDNYGRNYDYGMDYWGQGTLVTVSSGGGGSGGGGSGGGGSEIVLTQSPATLSLSPGERATLTCSATSSVSYIHWYQQRPGQSPRLLIYSTSNLASGIPARFSGSGSGSDYTLTISSLEPEDFAVYYCQQRSSSPFTFGSGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2305 - protein, 488 aa, Artificial Sequence
  source: /note="Description of Artificial Sequence: Synthetic Chimeric Antigen Receptor sequence"
MALPVTALLLPLALLLHAARPEVQLVESGGGLVKPGGSLRLSCAASGFTFSGYAMSWVRQAPGKGLEWVSTISSGGTYIYYPDSVKGRFTISRDNAKNSLYLQMNSLRAEDTAVYYCARLGGDNYYEYFDVWGKGTTVTVSSGGGGSGGGGSGGGGSDIVLTQSPASLAVSPGQRATITCRASKSVSTSGYSYMHWYQQKPGQPPKLLIYLASNLESGVPARFSGSGSGTDFTLTINPVEANDTANYYCQHSRELPFTFGGGTKVEIKRTTTTPAPRPPTPAPTIASQPLSLRPEACRPAAGGAVHTRGLDFACDIYIWAPLAGTCGVLLLSLVITLYCRRDQRLPPDAHKPPGGGSFRTPIQEEQADAHSTLAKIRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2306 - protein, 492 aa, Artificial Sequence
  source: /note="Description of Artificial Sequence: Synthetic Chimeric Antigen Receptor sequence"
MALPVTALLLPLALLLHAARPEVQLVESGGGLVKPGGSLRLSCAASGFTFSGYAMSWVRQAPGKGLEWVSTISSGGTYIYYPDSVKGRFTISRDNAKNSLYLQMNSLRAEDTAVYYCARLGGDNYYEYFDVWGKGTTVTVSSGGGGSGGGGSGGGGSDIVLTQSPASLAVSPGQRATITCRASKSVSTSGYSYMHWYQQKPGQPPKLLIYLASNLESGVPARFSGSGSGTDFTLTINPVEANDTANYYCQHSRELPFTFGGGTKVEIKRTTTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2307 - protein, 493 aa, Artificial Sequence
  source: /note="Description of Artificial Sequence: Synthetic Chimeric Antigen Receptor sequence"
MALPVTALLLPLALLLHAARPEVQLVESGGGLVKPGGSLRLSCAASGFTFSGYAMSWVRQAPGKGLEWVSTISSGGTYIYYPDSVKGRFTISRDNAKNSLYLQMNSLRAEDTAVYYCARLGGDNYYEYFDVWGKGTTVTVSSGGGGSGGGGSGGGGSDIVLTQSPASLAVSPGQRATITCRASKSVSTSGYSYMHWYQQKPGQPPKLLIYLASNLESGVPARFSGSGSGTDFTLTINPVEANDTANYYCQHSRELPFTFGGGTKVEIKRTTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2308 - protein, 513 aa, Artificial Sequence
  source: /note="Description of Artificial Sequence: Synthetic Chimeric Antigen Receptor sequence"
EVQLVESGGGLVKPGGSLRLSCAASGFTFSGYAMSWVRQAPGKGLEWVSTISSGGTYIYYPDSVKGRFTISRDNAKNSLYLQMNSLRAEDTAVYYCARLGGDNYYEYFDVWGKGTTVTVSSGGGGSGGGGSGGGGSDIVLTQSPASLAVSPGQRATITCRASKSVSTSGYSYMHWYQQKPGQPPKLLIYLASNLESGVPARFSGSGSGTDFTLTINPVEANDTANYYCQHSRELPFTFGGGTKVEIKRTTTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2309 - protein, 523 aa, Artificial Sequence
  source: /note="Description of Artificial Sequence: Synthetic Chimeric Antigen Receptor sequence"
MALPVTALLLPLALLLHAARPEVQLVESGGGLVKPGGSLRLSCAASGFTFSRYGMSWVRQAPGKRLEWVSTISGGGTYIYYPDSVKGRFTISRDNAKNTLYLQMNSLRAEDTAVYYCTRDNYGRNYDYGMDYWGQGTLVTVSSGGGGSGGGGSGGGGSEIVLTQSPATLSLSPGERATLTCSATSSVSYIHWYQQRPGQSPRLLIYSTSNLASGIPARFSGSGSGSDYTLTISSLEPEDFAVYYCQQRSSSPFTFGSGTKVEIKTTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSRRDQRLPPDAHKPPGGGSFRTPIQEEQADAHSTLAKIRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2310 - protein, 528 aa, Artificial Sequence
  source: /note="Description of Artificial Sequence: Synthetic Chimeric Antigen Receptor sequence"
MALPVTALLLPLALLLHAARPEVQLVESGGGLVKPGGSLRLSCAASGFTFSRYGMSWVRQAPGKRLEWVSTISGGGTYIYYPDSVKGRFTISRDNAKNTLYLQMNSLRAEDTAVYYCTRDNYGRNYDYGMDYWGQGTLVTVSSGGGGSGGGGSGGGGSEIVLTQSPATLSLSPGERATLTCSATSSVSYIHWYQQRPGQSPRLLIYSTSNLASGIPARFSGSGSGSDYTLTISSLEPEDFAVYYCQQRSSSPFTFGSGTKVEIKTTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2311 - protein, 529 aa, Artificial Sequence
  source: /note="Description of Artificial Sequence: Synthetic Chimeric Antigen Receptor sequence"
MALPVTALLLPLALLLHAARPEVQLVESGGGLVKPGGSLRLSCAASGFTFSGYAMSWVRQAPGKGLEWVSTISSGGTYIYYPDSVKGRFTISRDNAKNSLYLQMNSLRAEDTAVYYCARLGGDNYYEYFDVWGKGTTVTVSSGGGGSGGGGSGGGGSDIVLTQSPASLAVSPGQRATITCRASKSVSTSGYSYMHWYQQKPGQPPKLLIYLASNLESGVPARFSGSGSGTDFTLTINPVEANDTANYYCQHSRELPFTFGGGTKVEIKRTTTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSRRDQRLPPDAHKPPGGGSFRTPIQEEQADAHSTLAKIRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2312 - protein, 535 aa, Artificial Sequence
  source: /note="Description of Artificial Sequence: Synthetic Chimeric Antigen Receptor sequence"
MALPVTALLLPLALLLHAARPEVQLQQSGGERATPGASVKMSCKTSGYTFTNYWMHWVKQRPGQGLEWIGYINPSSGYTQYNQKFKDKATLTADKSSSTAYIQLSSLTSEDSAVYYCSTYYGDYLFPYWGQGTLVTVSAGGGGSGGGGSGGGGSDVLMTQTPLSLPVSLGDQASISCRSSQDIVYGNGNTYLEWYLQKPGQSPKLLIYKVSNRFSGVPDRFSGSGSGTDFTLKISRVEAEDLGVYYCFQGSHVPYTFGGGTKLEIKRAAAIEVEQKLISEEDLLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2313 - protein, 555 aa, Artificial Sequence
  source: /note="Description of Artificial Sequence: Synthetic Chimeric Antigen Receptor sequence"
MALPVTALLLPLALLLHAARPEVQLQQSGGERATPGASVKMSCKTSGYTFTNYWMHWVKQRPGQGLEWIGYINPSSGYTQYNQKFKDKATLTADKSSSTAYIQLSSLTSEDSAVYYCSTYYGDYLFPYWGQGTLVTVSAGGGGSGGGGSGGGGSDVLMTQTPLSLPVSLGDQASISCRSSQDIVYGNGNTYLEWYLQKPGQSPKLLIYKVSNRFSGVPDRFSGSGSGTDFTLKISRVEAEDLGVYYCFQGSHVPYTFGGGTKLEIKRAAAIEVEQKLISEEDLLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRDQRLPPDAHKPPGECLMALPHCSWRVRPTHQSLLFSSPGGGSFRTPIQEEQADAHSTLAKIRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2314 - protein, 1397 aa, Artificial Sequence
  source: /note="Description of Artificial Sequence: Synthetic Chimeric Antigen Receptor sequence"
MEEISAAAVKVVPGPERPSPFSQLVYTSNDSYIVHSGDLRKIHKAASRGQVRKLEKMTKRKKTINLNIQDAQKRTALHWACVNGHEEVVTFLVDRKCQLDVLDGEHRTPLMKALQCHQEACANILIDSGADINLVDVYGNTALHYAVYSEILSVVAKLLSHGAVIEVHNKASLTPLLLSITKRSEQIVEFLLIKNANANAVNKYKCTALMLAVCHGSSEIVGMLLQQNVDVFAADICGVTAEHYAVTCGFHHIHEQIMEYIRKLSKNHQNTNPEGTSAGTPDEAAPLAERTPDTAESLVEKTPDEAAPLVERTPDTAESLVEKTPDEAASLVEGTSDKIQCLEKATSGKFEQSAEETPREITSPAKETSEKFTWPAKGRPRKIAWEKKEDTPREIMSPAKETSEKFTWAAKGRPRKIAWEKKETPVKTGCVARVTSNKTKVLEKGRSKMIACPTKESSTKASANDQRFPSESKQEEDEEYSCDSRSLFESSAKIQVCIPESIYQKVMEINREVEEPPKKPSAFKPAIEMQNSVPNKAFELKNEQTLRADPMFPPESKQKDYEENSWDSESLCETVSQKDVCLPKATHQKEIDKINGKLEESPNKDGLLKATCGMKVSIPTKALELKDMQTFKAEPPGKPSAFEPATEMQKSVPNKALELKNEQTLRADEILPSESKQKDYEENSWDTESLCETVSQKDVCLPKAAHQKEIDKINGKLEGSPVKDGLLKANCGMKVSIPTKALELMDMQTFKAEPPEKPSAFEPAIEMQKSVPNKALELKNEQTLRADEILPSESKQKDYEESSWDSESLCETVSQKDVCLPKATHQKEIDKINGKLEESPDNDGFLKAPCRMKVSIPTKALELMDMQTFKAEPPEKPSAFEPAIEMQKSVPNKALELKNEQTLRADQMFPSESKQKKVEENSWDSESLRETVSQKDVCVPKATHQKEMDKISGKLEDSTSLSKILDTVHSCERARELQKDHCEQRTGKMEQMKKKFCVLKKKLSEAKEIKSQLENQKVKWEQELCSVRLTLNQEEEKRRNADILNEKIREELGRIEEQHRKELEVKQQLEQALRIQDIELKSVESNLNQVSHTHENENYLLHENCMLKKEIAMLKLEIATLKHQYQEKENKYFEDIKILKEKNAELQMTLKLKEESLTKRASQYSGQLKVLIAENTMLTSKLKEKQDKEILEAEIESHHPRLASAVQDHDQIVTSRKSQEPAFHIAGDACLQRKMNVDVSSTIYNNEVLHQPLSEAQRKSKSLKINLNYAGDALRENTLVSEHAQRDQRETQCQMKEAEHMYQNEQDNVNKHTEQQESLDQKLFQLQSKNMWLQQQLVHAHKKADNKSKITIDIHFLERKMQHHLLKEKNEEIFNYNNHLKNRIYQYEKEKAETENS

SEQ ID NO: 2315 - protein, 463 aa, Artificial Sequence
  source: /note="Description of Artificial Sequence: Synthetic Chimeric Antigen Receptor sequence"
VQLQESGPDLVKPSQSLSLTCTVTGYSITSGYSWHWIRQFPGNKLEWMGYIHYSGDTDYNPSLKSRFSITRDTSKNQFFLQLNSVTTEDTATYYCATPGGFVYWGQGTLVTVSAGGGGSGGGGSGGGGSDVVMTQTPLTLSVTIGQPASISCKSSQSLLDSDGKTYLHWLLQRPGQSPKRLIFLVSKLDSGVPDRFTGSGSGTDFTLKISRVEAEDLGVYYCWQGTHFPQTFGGGTKLEIKAAAIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2316 - protein, 394 aa, Artificial Sequence
  source: /note="Description of Artificial Sequence: Synthetic Chimeric Antigen Receptor sequence"
MALPVTALLLPLALLLHAARPPGWFLDSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLRAELRVTERRAEVPTAHPSPSPRPAGQFQTLVTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2317 - protein, 453 aa, Artificial Sequence
  source: /note="Description of Artificial Sequence: Synthetic Chimeric Antigen Receptor sequence"
MALPVTALLLPLALLLHAARPEVQLLESGGGLVQPGGSLRLSCAASGFTFSSYAMNWVRQAPGKGLEWVSAISDSGGSTYYADSVKGRFTISRDNSKNTLYLQMNSLRAEDTAVYYCARYWPMDIWGQGTLVTVSSGGGGSGGGGSGGGGSEIVLTQSPGTLSLSPGERATLSCRASQSVSSSYLAWYQQKPGQAPRLLMYDASIRATGIPDRFSGSGSGTDFTLTISRLEPEDFAVYYCQQYGSWPLTFGQGTKVEIKGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2318 - protein, 486 aa, Artificial Sequence
  source: /note="Description of Artificial Sequence: Synthetic Chimeric Antigen Receptor sequence"
VQLQESGPDLVKPSQSLSLTCTVTGYSITSGYSWHWIRQFPGNKLEWMGYIHYSGDTDYNPSLKSRFSITRDTSKNQFFLQLNSVTTEDTATYYCATPGGFVYWGQGTLVTVSAGGGGSGGGGSGGGGSDVVMTQTPLTLSVTIGQPASISCKSSQSLLDSDGKTYLHWLLQRPGQSPKRLIFLVSKLDSGVPDRFTGSGSGTDFTLKISRVEAEDLGVYYCWQGTHFPQTFGGGTKLEIKAAAFVPVFLPAKPTTTPAPRPPTPAPTIASQPLSLRPEACRPAAGGAVHTRGLDFACDIYIWAPLAGTCGVLLLSLVITLYCNHRNRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2319 - protein, 489 aa, Artificial Sequence
  source: /note="Description of Artificial Sequence: Synthetic Chimeric Antigen Receptor sequence"
MALPVTALLLPLALLLHAARPAIRMTQSPSSLSASVGDRVTITCQASQDISNYLNWYQQKPGKAPKLLIYDASNLETGVPSRFSGSGSGTDFTFTISSLQPEDIATYYCQQYDNLPLTFGGGTKVEIKRGGGGSGGGGSGGGGSEVQLVESGGGLVKPGGSLRLSCAASGFTFSDYYMSWIRQAPGKGLEWVSYISDSTNTIYYADSVKGRFTVSRDNPKNSLYLQMISLRAEDTAVYYCARAVGAGEGFDHWGQGTLVTVSSAAATTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2320 - protein, 527 aa, Artificial Sequence
  source: /note="Description of Artificial Sequence: Synthetic Chimeric Antigen Receptor sequence"
VQLQESGPDLVKPSQSLSLTCTVTGYSITSGYSWHWIRQFPGNKLEWMGYIHYSGDTDYNPSLKSRFSITRDTSKNQFFLQLNSVTTEDTATYYCATPGGFVYWGQGTLVTVSAGGGGSGGGGSGGGGSDVVMTQTPLTLSVTIGQPASISCKSSQSLLDSDGKTYLHWLLQRPGQSPKRLIFLVSKLDSGVPDRFTGSGSGTDFTLKISRVEAEDLGVYYCWQGTHFPQTFGGGTKLEIKAAAFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2321 - protein, 453 aa, Artificial Sequence
  source: /note="Description of Artificial Sequence: Synthetic Chimeric Antigen Receptor sequence"
MALPVTALLLPLALLLHAARPEVQLLESGGGLVQPGGSLRLSCAASGFTFSSYAMNWVRQAPGKGLEWVSAILSSGGSTYYADSVKGRFTISRDNSKNTLYLQMNSLRAEDTAVYYCARYWPMDIWGQGTLVTVSSGGGGSGGGGSGGGGSEIVLTQSPGTLSLSPGERATLSCRGGQSVSSSYLAWYQQKPGQAPRLLMYDASIRATGIPDRFSGSGSGTDFTLTISRLEPEDFAVYYCQQYQSWPLTFGQGTKVEIKGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2322 - protein, 482 aa, Artificial Sequence
  source: /note="Description of Artificial Sequence: Synthetic Chimeric Antigen Receptor sequence"
MALPVTALLLPLALLLHAARPEVQLLESGGGLVQPGGSLRLSCAASGFTFSSYAMNWVRQAPGKGLEWVSAISDSGGSTYYADSVKGRFTISRDNSKNTLYLQMNSLRAEDTAVYYCARYWPMDIWGQGTLVTVSSGGGGSGGGGSGGGGSEIVLTQSPGTLSLSPGERATLSCRASQSVSSSYLAWYQQKPGQAPRLLMYDASIRATGIPDRFSGSGSGTDFTLTISRLEPEDFAVYYCQQYGSWPLTFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2323 - protein, 668 aa, Artificial Sequence
  source: /note="Description of Artificial Sequence: Synthetic Chimeric Antigen Receptor sequence"
MALPVTALLLPLALLLHAARPEVQLLESGGGLVQPGGSLRLSCAASGFTFSSYAMNWVRQAPGKGLEWVSAISDSGGSTYYADSVKGRFTISRDNSKNTLYLQMNSLRAEDTAVYYCARYWPMDIWGQGTLVTVSSGGGGSGGGGSGGGGSEIVLTQSPGTLSLSPGERATLSCRASQSVSSSYLAWYQQKPGQAPRLLMYDASIRATGIPDRFSGSGSGTDFTLTISRLEPEDFAVYYCQQYGSWPLTFGQGTKVEIKEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2324 - protein, 453 aa, Artificial Sequence
  source: /note="Description of Artificial Sequence: Synthetic Chimeric Antigen Receptor sequence"
MALPVTALLLPLALLLHAARPEVQLLESGGGLVQPGGSLRLSCAASGFTFSSYAMNWVRQAPGKGLEWVSAISDFGGSTYYADSVKGRFTISRDNSKNTLYLQMNSLRAEDTAVYYCARYWPMDIWGQGTLVTVSSGGGGSGGGGSGGGGSEIVLTQSPGTLSLSPGERATLSCRASQSVSDIYLAWYQQKPGQAPRLLMYDASIRATGIPDRFSGSGSGTDFTLTISRLEPEDFAVYYCQQYQTWPLTFGQGTKVEIKGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2325 - protein, 482 aa, Artificial Sequence
  source: /note="Description of Artificial Sequence: Synthetic Chimeric Antigen Receptor sequence"
MALPVTALLLPLALLLHAARPEVQLLESGGGLVQPGGSLRLSCAASGFTFSSYAMNWVRQAPGKGLEWVSAILSSGGSTYYADSVKGRFTISRDNSKNTLYLQMNSLRAEDTAVYYCARYWPMDIWGQGTLVTVSSGGGGSGGGGSGGGGSEIVLTQSPGTLSLSPGERATLSCRGGQSVSSSYLAWYQQKPGQAPRLLMYDASIRATGIPDRFSGSGSGTDFTLTISRLEPEDFAVYYCQQYQSWPLTFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2326 - protein, 519 aa, Artificial Sequence
  source: /note="Description of Artificial Sequence: Synthetic Chimeric Antigen Receptor sequence"
MALPVTALLLPLALLLHAARPEVQLLESGGGLVQPGGSLRLSCAASGFTFSSYAMNWVRQAPGKGLEWVSAILSSGGSTYYADSVKGRFTISRDNSKNTLYLQMNSLRAEDTAVYYCARYWPMDIWGQGTLVTVSSGGGGSGGGGSGGGGSEIVLTQSPGTLSLSPGERATLSCRGGQSVSSSYLAWYQQKPGQAPRLLMYDASIRATGIPDRFSGSGSGTDFTLTISRLEPEDFAVYYCQQYQSWPLTFGQGTKVEIKGSGGGGSCPYSNPSLCSGGGGSCPYSNPSLCSGGGGSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2327 - protein, 668 aa, Artificial Sequence
  source: /note="Description of Artificial Sequence: Synthetic Chimeric Antigen Receptor sequence"
MALPVTALLLPLALLLHAARPEVQLLESGGGLVQPGGSLRLSCAASGFTFSSYAMNWVRQAPGKGLEWVSAILSSGGSTYYADSVKGRFTISRDNSKNTLYLQMNSLRAEDTAVYYCARYWPMDIWGQGTLVTVSSGGGGSGGGGSGGGGSEIVLTQSPGTLSLSPGERATLSCRGGQSVSSSYLAWYQQKPGQAPRLLMYDASIRATGIPDRFSGSGSGTDFTLTISRLEPEDFAVYYCQQYQSWPLTFGQGTKVEIKEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2328 - protein, 453 aa, Artificial Sequence
  source: /note="Description of Artificial Sequence: Synthetic Chimeric Antigen Receptor sequence"
MALPVTALLLPLALLLHAARPEVQLLESGGGLVQPGGSLRLSCAASGFTFGSYAMTWVRQAPGKGLEWVSAISGSGGNTFYADSVKGRFTISRDNSKNTLYLQMNSLRAEDTAVYYCARVSPIAAPMDYWGQGTLVTVSSGGGGSGGGGSGGGGSEIVLTQSPGTLSLSPGERATLSCRASQLGSFYLAWYQQKPGQAPRLLIYGASSRATGIPDRFSGSGSGTDFTLTISRLEPEDFAVYYCQHYNYPPSFTFGQGTKVEIKGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQA

SEQ ID NO: 2329 - protein, 482 aa, Artificial Sequence
  source: /note="Description of Artificial Sequence: Synthetic Chimeric Antigen Receptor sequence"
MALPVTALLLPLALLLHAARPEVQLLESGGGLVQPGGSLRLSCAASGFTFSSYAMNWVRQAPGKGLEWVSAISDFGGSTYYADSVKGRFTISRDNSKNTLYLQMNSLRAEDTAVYYCARYWPMDIWGQGTLVTVSSGGGGSGGGGSGGGGSEIVLTQSPGTLSLSPGERATLSCRASQSVSDIYLAWYQQKPGQAPRLLMYDASIRATGIPDRFSGSGSGTDFTLTISRLEPEDFAVYYCQQYQTWPLTFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2330 - protein, 668 aa, Artificial Sequence
  source: /note="Description of Artificial Sequence: Synthetic Chimeric Antigen Receptor sequence"
MALPVTALLLPLALLLHAARPEVQLLESGGGLVQPGGSLRLSCAASGFTFSSYAMNWVRQAPGKGLEWVSAISDFGGSTYYADSVKGRFTISRDNSKNTLYLQMNSLRAEDTAVYYCARYWPMDIWGQGTLVTVSSGGGGSGGGGSGGGGSEIVLTQSPGTLSLSPGERATLSCRASQSVSDIYLAWYQQKPGQAPRLLMYDASIRATGIPDRFSGSGSGTDFTLTISRLEPEDFAVYYCQQYQTWPLTFGQGTKVEIKEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2331 - protein, 453 aa, Artificial Sequence
  source: /note="Description of Artificial Sequence: Synthetic Chimeric Antigen Receptor sequence"
MALPVTALLLPLALLLHAARPEVQLLESGGGLVQPGGSLRLSCAASGFTFGSYAMTWVRQAPGKGLEWVSAIDYSGGNTFYADSVKGRFTISRDNSKNTLYLQMNSLRAEDTAVYYCARVSPIASGMDYWGQGTLVTVSSGGGGSGGGGSGGGGSEIVLTQSPGTLSLSPGERATLSCRASQSVSSSYPSWYQQKPGQAPRLLIYGASSRATGIPDRFSGSGSGTDFTLTISRLEPEDFAVYYCQHYPYPPSFTFGQGTKVEIKGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQ

SEQ ID NO: 2332 - protein, 486 aa, Artificial Sequence
  source: /note="Description of Artificial Sequence: Synthetic Chimeric Antigen Receptor sequence"
MALPVTALLLPLALLLHAARPEVQLLESGGGLVQPGGSLRLSCAASGFTFGSYAMTWVRQAPGKGLEWVSAISGSGGNTFYADSVKGRFTISRDNSKNTLYLQMNSLRAEDTAVYYCARVSPIAAPMDYWGQGTLVTVSSGGGGSGGGGSGGGGSEIVLTQSPGTLSLSPGERATLSCRASQLGSFYLAWYQQKPGQAPRLLIYGASSRATGIPDRFSGSGSGTDFTLTISRLEPEDFAVYYCQHYNYPPSFTFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2333 - protein, 672 aa, Artificial Sequence
  source: /note="Description of Artificial Sequence: Synthetic Chimeric Antigen Receptor sequence"
MALPVTALLLPLALLLHAARPEVQLLESGGGLVQPGGSLRLSCAASGFTFGSYAMTWVRQAPGKGLEWVSAISGSGGNTFYADSVKGRFTISRDNSKNTLYLQMNSLRAEDTAVYYCARVSPIAAPMDYWGQGTLVTVSSGGGGSGGGGSGGGGSEIVLTQSPGTLSLSPGERATLSCRASQLGSFYLAWYQQKPGQAPRLLIYGASSRATGIPDRFSGSGSGTDFTLTISRLEPEDFAVYYCQHYNYPPSFTFGQGTKVEIKEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2334 - protein, 453 aa, Artificial Sequence
  source: /note="Description of Artificial Sequence: Synthetic Chimeric Antigen Receptor sequence"
MALPVTALLLPLALLLHAARPEVQLLESGGGLVQPGGSLRLSCAASGFTFSSYPMSWVRQAPGKGLEWVSAIGGSGGSTYYADSVKGRFTISRDNSKNTLYLQMNSLRAEDTAVYYCARYWPMDSWGQGTLVTVSSGGGGSGGGGSGGGGSEIVLTQSPGTLSLSPGERATLSCRASQSVSSTYLAWYQQKPGQAPRLLIYDASSRAPGIPDRFSGSGSGTDFTLTISRLEPEDFAVYYCQQYSTSPLTFGQGTKVEIKGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2335 - protein, 487 aa, Artificial Sequence
  source: /note="Description of Artificial Sequence: Synthetic Chimeric Antigen Receptor sequence"
MALPVTALLLPLALLLHAARPEVQLLESGGGLVQPGGSLRLSCAASGFTFGSYAMTWVRQAPGKGLEWVSAIDYSGGNTFYADSVKGRFTISRDNSKNTLYLQMNSLRAEDTAVYYCARVSPIASGMDYWGQGTLVTVSSGGGGSGGGGSGGGGSEIVLTQSPGTLSLSPGERATLSCRASQSVSSSYPSWYQQKPGQAPRLLIYGASSRATGIPDRFSGSGSGTDFTLTISRLEPEDFAVYYCQHYPYPPSFTFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2336 - protein, 673 aa, Artificial Sequence
  source: /note="Description of Artificial Sequence: Synthetic Chimeric Antigen Receptor sequence"
MALPVTALLLPLALLLHAARPEVQLLESGGGLVQPGGSLRLSCAASGFTFGSYAMTWVRQAPGKGLEWVSAIDYSGGNTFYADSVKGRFTISRDNSKNTLYLQMNSLRAEDTAVYYCARVSPIASGMDYWGQGTLVTVSSGGGGSGGGGSGGGGSEIVLTQSPGTLSLSPGERATLSCRASQSVSSSYPSWYQQKPGQAPRLLIYGASSRATGIPDRFSGSGSGTDFTLTISRLEPEDFAVYYCQHYPYPPSFTFGQGTKVEIKEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2337 - protein, 453 aa, Artificial Sequence
  source: /note="Description of Artificial Sequence: Synthetic Chimeric Antigen Receptor sequence"
MALPVTALLLPLALLLHAARPEVQLLESGGGLVQPGGSLRLSCAASGFTFSSYPMSWVRQAPGKGLEWVSAIGGSGGWSYYADSVKGRFTISRDNSKNTLYLQMNSLRAEDTAVYYCARYWPMDSWGQGTLVTVSSGGGGSGGGGSGGGGSEIVLTQSPGTLSLSPGERATLSCWLSQSVSSTYLAWYQQKPGQAPRLLIYDASSRAPGIPDRFSGSGSGTDFTLTISRLEPEDFAVYYCQQYSEWPLTFGQGTKVEIKGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2338 - protein, 482 aa, Artificial Sequence
  source: /note="Description of Artificial Sequence: Synthetic Chimeric Antigen Receptor sequence"
MALPVTALLLPLALLLHAARPEVQLLESGGGLVQPGGSLRLSCAASGFTFSSYPMSWVRQAPGKGLEWVSAIGGSGGSTYYADSVKGRFTISRDNSKNTLYLQMNSLRAEDTAVYYCARYWPMDSWGQGTLVTVSSGGGGSGGGGSGGGGSEIVLTQSPGTLSLSPGERATLSCRASQSVSSTYLAWYQQKPGQAPRLLIYDASSRAPGIPDRFSGSGSGTDFTLTISRLEPEDFAVYYCQQYSTSPLTFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2339 - protein, 668 aa, Artificial Sequence
  source: /note="Description of Artificial Sequence: Synthetic Chimeric Antigen Receptor sequence"
MALPVTALLLPLALLLHAARPEVQLLESGGGLVQPGGSLRLSCAASGFTFSSYPMSWVRQAPGKGLEWVSAIGGSGGSTYYADSVKGRFTISRDNSKNTLYLQMNSLRAEDTAVYYCARYWPMDSWGQGTLVTVSSGGGGSGGGGSGGGGSEIVLTQSPGTLSLSPGERATLSCRASQSVSSTYLAWYQQKPGQAPRLLIYDASSRAPGIPDRFSGSGSGTDFTLTISRLEPEDFAVYYCQQYSTSPRIFGQGTKVEIKEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2340 - protein, 482 aa, Artificial Sequence
  source: /note="Description of Artificial Sequence: Synthetic Chimeric Antigen Receptor sequence"
MALPVTALLLPLALLLHAARPEVQLLESGGGLVQPGGSLRLSCAASGFTFSSYPMSWVRQAPGKGLEWVSAIGGSGGWSYYADSVKGRFTISRDNSKNTLYLQMNSLRAEDTAVYYCARYWPMDSWGQGTLVTVSSGGGGSGGGGSGGGGSEIVLTQSPGTLSLSPGERATLSCWLSQSVSSTYLAWYQQKPGQAPRLLIYDASSRAPGIPDRFSGSGSGTDFTLTISRLEPEDFAVYYCQQYSEWPLTFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2341 - protein, 668 aa, Artificial Sequence
  source: /note="Description of Artificial Sequence: Synthetic Chimeric Antigen Receptor sequence"
MALPVTALLLPLALLLHAARPEVQLLESGGGLVQPGGSLRLSCAASGFTFSSYPMSWVRQAPGKGLEWVSAIGGSGGWSYYADSVKGRFTISRDNSKNTLYLQMNSLRAEDTAVYYCARYWPMDSWGQGTLVTVSSGGGGSGGGGSGGGGSEIVLTQSPGTLSLSPGERATLSCWLSQSVSSTYLAWYQQKPGQAPRLLIYDASSRAPGIPDRFSGSGSGTDFTLTISRLEPEDFAVYYCQQYSEWPLTFGQGTKVEIKEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2342 - protein, 373 aa, Artificial Sequence
  source: /note="Description of Artificial Sequence: Synthetic Chimeric Antigen Receptor sequence"
PGWFLDSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLRAELRVTERRAEVPTAHPSPSPRPAGQFQTLVTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2343 - protein, 354 aa, Artificial Sequence
  source: /note="Description of Artificial Sequence: Synthetic Chimeric Antigen Receptor sequence"
MALPVTALLLPLALLLHAARPPGWFLDSPDRPWNPPTFSPALLVVTEGDNATFTCSFSNTSESFYLNWYRMSPSNQTDKLAAFPEDRSQPGQDCRFRVTQLPNGRDFHMSVYRARRNDSGTYLCGAISLAPKAQIKESLRAELRVTERRAEVPTAHPSPSPRPAGQFQTLVTTTPAPRPPTPAPTIASQPLSLRPEACRPAAGGAVHTRGLDFACDIYIWAPLAGDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2344 - protein, 367 aa, Artificial Sequence
  source: /note="Description of Artificial Sequence: Synthetic Chimeric Antigen Receptor sequence"
MALPVTALLLPLALLLHAARPPGWFLDSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLRAELRVTERRAEVPTAHPSPSPRPAGQFQTLVTTTPAPRPPTPAPTIASQPLSLRPEACRPAAGGAVHTRGLDFACDIYIWAPLAGTCGVLLLSLVITLYCKRGRKKLLGGGGSGGGGSGVQVETISPGDGRTFPKRGQTCVVHYTGMLEDGKKFDSSRDRNKPFKFMLGKQEVIRGWEEGVAQMSVGQRAKLTISPDYAYGATGHPGIIPPHATLVFDVELLKLETS

SEQ ID NO: 2345 - protein, 372 aa, Artificial Sequence
  source: /note="Description of Artificial Sequence: Synthetic Chimeric Antigen Receptor sequence"
PGWFLDSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTVLCGAISLAPKAQIKESHAELRVTERRAEVPTAHPSPSPRPAGQFQTLVTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2346 - protein, 373 aa, Artificial Sequence; identical to SEQ ID NO: 2342
  source: /note="Description of Artificial Sequence: Synthetic Chimeric Antigen Receptor sequence"

SEQ ID NO: 2347 - protein, 373 aa, Artificial Sequence; identical to SEQ ID NO: 2342
  source: /note="Description of Artificial Sequence: Synthetic Chimeric Antigen Receptor sequence"

SEQ ID NO: 2348 - protein, 373 aa, Artificial Sequence
  source: /note="Description of Artificial Sequence: Synthetic Chimeric Antigen Receptor sequence"
PGWFLDSPDRPWNPPTFSPALLVVTEGDNATFTCSFSNTSESFYLNWYRMSPSNQTDKLAAFPEDRSQPGQDCRFRVTQLPNGRDFHMSVYRARRNDSGTYLCGAISLAPKAQIKESLRAELRVTERRAEVPTAHPSPSPRPAGQFQTLVTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2349 - protein, 386 aa, Artificial Sequence
  source: /note="Description of Artificial Sequence: Synthetic Chimeric Antigen Receptor sequence"
MALPVTALLLPLALLLHAARPGSGSGAQAAEVQLQQSGPELVKPGTSVRISCKTSGYTFTEYTIHWVKQSHGKSLEWIGNINPNNGGTTYNQKFEDKATLTVDKSSSTAYMELRSLTSEDSAVYYCAAGWNFDYWGQGTTVTVSSGGGGSGGGGSGGGGSDIVMTQSHKFMSTSVGDRVSIICKASQDVGTAVDWYQQKPGQSPKLLIYWASTRHTGVPDRFTGSGSGTDFTLTITNVQSEDLADYFCQQYNSYPLTFGAGTMLDLKRAAARSDPASGAGSGSGSAIELLPVPGAKKSAKLYIPYIILTIIILTIVGFIWLLKVNGCRKYKLNKTESTPVVEEDEMQPYASYTEKNNPLYDTTNKVKASEALQSEVDTDLHTLSHG

SEQ ID NO: 2350 - protein, 390 aa, Artificial Sequence
  source: /note="Description of Artificial Sequence: Synthetic Chimeric Antigen Receptor sequence"
MALPVTALLLPLALLLHAARPPGWFLDSPDRPWPPTFSPALLVVTEGDNATFTCSFSNTSESFVLNWYRMSPSNQTDKLAAFPEDRSQPGQDCRFRVTQLPNGRDFHMSVWARRDSGTYLCGAISLAPKAQIKESLRAELRVTERRAEVPTAHPSPSPRPAGQFQTLVTTTPAPRPPTPAPTIASQPLSLRPEACRPAAGGAVHTRGLDFACDRYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKPQEGLYNELQKDKMAEAYSEIGMKGERRRGKGHDGLYQGLSTATKDTYDALHMQALPPR

SEQ ID NO: 2351 - protein, 394 aa, Artificial Sequence
  source: /note="Description of Artificial Sequence: Synthetic Chimeric Antigen Receptor sequence"
MALPVTALLLPLALLLHAARPPGWFLDSPDRPWNPPTFSPALLVVTEGDNATFTCSFSNTSESFVLNWVRMSPSNQTDKLAAFPEDRSQPGQDCRFRVTQLPNGRDFHMSVVRARRNDSGTVLCGAISLAPKAQIKESLRAELRVTERRAEVPTAHPSPSPRPAGQFQTLVTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2352 - protein, 394 aa, Artificial Sequence
  source: /note="Description of Artificial Sequence: Synthetic Chimeric Antigen Receptor sequence"
MALPVTALLLPLALLLHAARPPGWFLDSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLRAEIRVTERRAEVPTAHPSPSPRPAGQFQTLVTTTPAPRPPTPAPTIASQPLSLRPEACRPAAGGAVHTRGLDFACDIYIWAPLAGTCGVLIISLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2353 - protein, 488 aa, Artificial Sequence
  source: /note="Description of Artificial Sequence: Synthetic Chimeric Antigen Receptor sequence"
MALPVTALLLPLALLLHAARPQVQLVQSGGGLVQPGRSLRLSCAASGFTFDDYAMHWVRQAPGKGLEWVSGISWNSGSIGYADSVKGRFTISRDNAKNSLYLQMNSLRAEDTAVYYCAKDGSSSWSWGYFDYWGQGTLVTVSSGGGGSGGGGSGGGGSSSELTQDPAVSVALGQTVRTTCQGDALRSYYASWYQQKPGQAPMLVIYGKNNRPSGIPDRFSGSDSGDTASLTITGAQAEDEADYYCNSRDSSGYPVFGTGTKVTVLTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2354 - DNA, 1182 bp, Artificial Sequence
  source: /note="Description of Artificial Sequence: Synthetic Chimeric Antigen Receptor sequence"
atggccctccctgtcactgccctgcttctccccctcgcactcctgctccacgccgctagaccacccggatggtttctggactctccggatcgcccgtggaatcccccaaccttctcaccggcactcttggttgtgactgagggcgataatgcgaccttcacgtgctcgttctccaacacctccgaatcattcgtgctgaactggtaccgcatgagcccgtcaaaccagaccgacaagctcgccgcgtttccggaagatcggtcgcaaccgggacaggattgtcggttccgcgtgactcaactgccgaatggcagagacttccacatgagcgtggtccgcgctaggcgaaacgactccgggacctacctgtgcggagccatctcgctggcgcctaaggcccaaatcaaagagagcttgagggccgaactgagagtgaccgagcgcagagctgaggtgccaactgcacatccatccccatcgcctcggcctgcggggcagtttcagaccctggtcacgaccactccggcgccgcgcccaccgactccggccccaactatcgcgagccagcccctgtcgctgaggccggaagcatgccgccctgccgccggaggtgctgtgcatacccggggattggacttcgcatgcgacatctacatttgggctcctctcgccggaacttgtggcgtgctccttctgtccctggtcatcaccctgtactgcaagcggggtcggaaaaagcttctgtacattttcaagcagcccttcatgaggcccgtgcaaaccacccaggaggaggacggttgctcctgccggttccccgaagaggaagaaggaggttgcgagctgcgcgtgaagttctcccggagcgccgacgcccccgcctataagcagggccagaaccagctgtacaacgaactgaacctgggacggcgggaagagtacgatgtgctggacaagcggcgcggccgggaccccgaaatgggcgggaagcctagaagaaagaaccctcaggaaggcctgtataacgagctgcagaaggacaagatggccgaggcctactccgaaattgggatgaagggagagcggcggaggggaaaggggcacgacggcctgtaccaaggactgtccaccgccaccaaggacacatacgatgccctgcacatgcaggcccttccccctcgc

SEQ ID NO: 2355 - protein, 488 aa, Artificial Sequence
  source: /note="Description of Artificial Sequence: Synthetic Chimeric Antigen Receptor sequence"
MALPVTALLLPLALLLHAARPQVQLQQSGAEVKKPGASVKVSCKASGYTFTGYYMHWVRQAPGQGLEWMGRINPNSGGTNYAQKFQGRVTMTRDTSISTAYMELSRLRSEDTAVYYCARGRYYGMDVWGQGTMVTVSSGGGGSGGGGSGGGGSGGGGSEIVLTQSPATLSLSPGERATISCRASQSVSSNFAWYQQRPGQAPRLLIYDASNRATGIPPRFSGSGSGTDFTLTISSLEPEDFAAYYCHQRSNWLYTFGQGTKVDIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2356 - protein, 499 aa, Artificial Sequence
  source: /note="Description of Artificial Sequence: Synthetic Chimeric Antigen Receptor sequence"
MALPVTALLLPLALLLHAARPQVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCARVAGGIYYYYGMDVWGQGTTITVSSGGGGSGGGGSGGGGSGGGGSDIVMTQTPDSLAVSLGERATISCKSSHSVLYNRNNKNYLAWYQQKPGQPPKLLFYWASTRKSGVPDRFSGSGSGTDFTLTISSLQPEDFATYFCQQTQTFPLTFGQGTRLEINTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2357 - protein, 485 aa, Artificial Sequence
  source: /note="Description of Artificial Sequence: Synthetic Chimeric Antigen Receptor sequence"
MALPVTALLLPLALLLHAARPQVQLQQSGAEVKKPGASVKVSCKASGYTFTGYYMHWVRQAPGQGLEWMGWINPNSGGTNYAQNFQGRVTMTRDTSISTAYMELRRLRSDDTAVYYCASGWDFDYWGQGTLVTVSSGGGGSGGGGSGGGGSGGGGSDIRMTQSPSSLSASVGDRVTITCRASQSIRYYLSWYQQKPGKAPKLLIYTASILQNGVPSRFSGSGSGTDFTLTISSLQPEDFATYYCLQTYTTPDFGPGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2358 - protein, 490 aa, Artificial Sequence
  source: /note="Description of Artificial Sequence: Synthetic Chimeric Antigen Receptor sequence"
MALPVTALLLPLALLLHAARPQVQLVQSGAEVKKPGASVKVSCKASGYTFTGYYMHWVRQAPGQGLEWMGRINPNSGGTNYAQKFQGRVTMTTDTSTSTAYMELRSLRSDDTAVYYCARTTTSYAFDIWGQGTMVTVSSGGGGSGGGGSGGGGSGGGGSDIQLTQSPSTLSASVGDRVTITCRASQSISTWLAWYQQKPGKAPNLLIYKASTLESGVPSRFSGSGSGTEFTLTISSLQPDDFATYYCQQYNTYSPYTFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2359 - protein, 493 aa, Artificial Sequence
  source: /note="Description of Artificial Sequence: Synthetic Chimeric Antigen Receptor sequence"
MALPVTALLLPLALLLHAARPQVQLVQSGGGLVKPGGSLRLSCEASGFIFSDYYMGWIRQAPGKGLEWVSYIGRSGSSMYYADSVKGRFTFSRDNAKNSLYLQMNSLRAEDTAVYYCAASPVVAATEDFQHWGQGTLVTVSSGGGGSGGGGSGGGGSGGGGSDIVMTQTPATLSLSPGERATLSCRASQSVTSNYLAWYQQKPGQAPRLLLFGASTRATGIPDRFSGSGSGTDFTLTINRLEPEDFAMYYCQQYGSAPVTFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2360 - protein, 493 aa, Artificial Sequence
  source: /note="Description of Artificial Sequence: Synthetic Chimeric Antigen Receptor sequence"
MALPVTALLLPLALLLHAARPQVQLVQSGAEVRAPGASVKISCKASGFTFRGYYIHWVRQAPGQGLEWMGIINPSGGSRAYAQKFQGRVTMTRDTSTSTVYMELSSLRSDDTAMYYCARTASCGGDCYYLDYWGQGTLVTVSSGGGGSGGGGSGGGGSGGGGSDIQMTQSPPTLSASVGDRVTITCRASENVNIWLAWYQQKPGKAPKLLIYKSSSLASGVPSRFSGSGSGAEFTLTISSLQPDDFATYYCQQYQSYPLTFGGGTKVDIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2361 - protein, 490 aa, Artificial Sequence
  source: /note="Description of Artificial Sequence: Synthetic Chimeric Antigen Receptor sequence"
MALPVTALLLPLALLLHAARPEVQLVESGGGLVQPGRSLRLSCAASGFTFDDYAMHWVRQAPGKGLEWVSGISWNSGSTGYADSVKGRFTISRDNAKNSLYLQMNSLRAEDTALYYCAKDSSSWYGGGSAFDIWGQGTMVTVSSGGGGSGGGGSGGGGSSSELTQEPAVSVALGQTVRITCQGDSLRSYYASWYQQKPGQAPVLVIFGRSRRPSGIPDRFSGSSSGNTASLIITGAQAEDEADYYCNSRDNTANHYVFGTGTKLTVLTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2362 - protein, 490 aa, Artificial Sequence
  source: /note="Description of Artificial Sequence: Synthetic Chimeric Antigen Receptor sequence"
MALPVTALLLPLALLLHAARPEVQLVESGGGLVQPGRSLRLSCAASGFTFDDYAMHWVRQAPGKGLEWVSGISWNSGSTGYADSVKGRFTISRDNAKNSLYLQMNSLRAEDTALYYCAKDSSSWYGGGSAFDIWGQGTMVTVSSGGGGSGGGGSGGGGSSSELTQDPAVSVALGQTVRITCQGDSLRSYYASWYQQKPGQAPVLVIYGKNNRPSGIPDRFSGSSSGNTASLTITGAQAEDEADYYCNSRGSSGNHYVFGTGTKVTVLTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2363 - protein, 495 aa, Artificial Sequence
  source: /note="Description of Artificial Sequence: Synthetic Chimeric Antigen Receptor sequence"
MALPVTALLLPLALLLHAARPQVQLVQSGGGLVQPGGSLRLSCAASGFTFSSYWMHWVRQAPGKGLVWVSRINSDGSSTSYADSVKGRFTISRDNAKNTLYLQMNSLRAEDTAVYYCVRTGWVGSYYYYMDVWGKGTTVTVSSGGGGSGGGGSGGGGSGGGGSEIVLTQSPGTLSLSPGERATLSCRASQSVSSNYLAWYQQKPGQPPRLLIYDVSTRATGIPARFSGGGSGTDFTLTISSLEPEDFAVYYCQQRSNWPPWTFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2364 - protein, 494 aa, Artificial Sequence
  source: /note="Description of Artificial Sequence: Synthetic Chimeric Antigen Receptor sequence"
MALPVTALLLPLALLLHAARPQVQLVQSGGGVVQPGRSLRLSCAASGFTFSSYGMHWVRQAPGKGLEWVAVISYDGSNKYYADSVKGRFTISRDNSKNTLYLQMNSLRAEDTAVYYCAKGYSRYYYYGMDVWGQGTTVTVSSGGGGSGGGGSGGGGSGGGGSEIVMTQSPATLSLSPGERAILSCRASQSVYTKYLGWYQQKPGQAPRLLIYDASTRATGIPDRFSGSGSGTDFTLTINRLEPEDFAVYYCQHYGGSPLITFGQGTKVDIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2365 - protein, 497 aa, Artificial Sequence
  source: /note="Description of Artificial Sequence: Synthetic Chimeric Antigen Receptor sequence"
MALPVTALLLPLALLLHAARPQVQLVQSGAEVKKPGASVKVSCKASGYTFTGYYMHWVRQAPGQGLEWMGWINPNSGGTNYAQKFQGRVTMTRDTSISTAYMELSRLRSDDTAVYYCARDLRRTVVTPRAYYGMDVWGQGTTVTVSSGGGGSGGGGSGGGGSGGGGSDIQLTQSPSTLSASVGDRVTITCQASQDISNSLNWYQQKAGKAPKLLIYDASTLETGVPSRFSGSGSGTDFSFTISSLQPEDIATYYCQQHDNLPLTFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2366 - protein, 493 aa, Artificial Sequence
  source: /note="Description of Artificial Sequence: Synthetic Chimeric Antigen Receptor sequence"
MALPVTALLLPLALLLHAARPQVQLVQSGGGLVQPGGSLRLSCAASGFTFSSYAMSWVRQAPGKGLEWVSAISGSGGSTYYADSVKGRFTISRDNSKNTLYLQMNSLRAEDTAVYYCAKREAAAGHDWYFDLWGRGTLVTVSSGGGGSGGGGSGGGGSGGGGSDIRVTQSPSSLSASVGDRVTITCRASQSISSYLNWYQQKPGKAPKLLIYAASSLQSGVPSRFSGSGSGTDFTLTISSLQPEDFATYYCQQSYSIPLTFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2367 - protein, 491 aa, Artificial Sequence
  source: /note="Description of Artificial Sequence: Synthetic Chimeric Antigen Receptor sequence"
MALPVTALLLPLALLLHAARPQVQLVQSWAEVKKPGASVKVSCKASGYTFTSYYMHWVRQAPGQGLEWMGIINPSGGSTSYAQKFQGRVTMTRDTSTSTVYMELSNLRSEDTAVYYCARSPRVTTGYFDYWGQGTLVTVSSGGGGSGGGGSGGGGSGGGGSDIQLTQSPSTLSASVGDRVTITCRASQSISSWLAWYQQKPGKAPKLLIYKASSLESGVPSRFSGSGSGTEFTLTISSLQPDDFATYYCQQYSSYPLTFGGGTRLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2368 - protein, 497 aa, Artificial Sequence
  source: /note="Description of Artificial Sequence: Synthetic Chimeric Antigen Receptor sequence"
MALPVTALLLPLALLLHAARPQVQLVQSGAEVRRPGASVKISCRASGDTSTRHYIHWLRQAPGQGPEWMGVINPTTGPATGSPAYAQMLQGRVTMTRDTSTRTVYMELRSLRFEDTAVYYCARSVVGRSAPYYFDYWGQGTLVTVSSGGGGSGGGGSGGGGSGGGGSDIQMTQSPSSLSASVGDRVTITCRASQGISDYSAWYQQKPGKAPKLLIYAASTLQSGVPSRFSGSGSGTDFTLTISYLQSEDFATYYCQQYYSYPLTFGGGTKVDIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2369 - protein, 493 aa, Artificial Sequence
  source: /note="Description of Artificial Sequence: Synthetic Chimeric Antigen Receptor sequence"
MALPVTALLLPLALLLHAARPQVQLQQSGAEVKKPGASVKVSCKASGYTFTNYYMHWVRQAPGQGLEWMGIINPSGGYTTYAQKFQGRLTMTRDTSTSTVYMELSSLRSEDTAVYYCARIRSCGGDCYYFDNWGQGTLVTVSSGGGGSGGGGSGGGGSGGGGSDIQLTQSPSTLSASVGDRVTITCRASENVNIWLAWYQQKPGKAPKLLIYKSSSLASGVPSRFSGSGSGAEFTLTISSLQPDDFATYYCQQYQSYPLTFGGGTKVDIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2370 - protein, 490 aa, Artificial Sequence
  source: /note="Description of Artificial Sequence: Synthetic Chimeric Antigen Receptor sequence"
MALPVTALLLPLALLLHAARPQITLKESGPALVKPTQTLTLTCTFSGFSLSTAGVHVGWIRQPPGKALEWLALISWADDKRYRPSLRSRLDITRVTSKDQVVLSMTNMQPEDTATYYCALQGFDGYEANWGPGTLVTVSSGGGGSGGGGSGGGGSGGGGSDIVMTQSPSSLSASAGDRVTITCRASRGISSALAWYQQKPGKPPKLLIYDASSLESGVPSRFSGSGSGTDFTLTIDSLEPEDFATYYCQQSYSTPWTFGQGTKVDIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2371 - protein, 490 aa, Artificial Sequence
  source: /note="Description of Artificial Sequence: Synthetic Chimeric Antigen Receptor sequence"
MALPVTALLLPLALLLHAARPQVQLVQSGAEVKKPGAPVKVSCKASGYTFTGYYMHWVRQAPGQGLEWMGWINPNSGGTNYAQKFQGRVTMTRDTSISTAYMELSRLRSDDTAVYYCARGEWDGSYYYDYWGQGTLVTVSSGGGGSGGGGSGGGGSGGGGSDIVLTQTPSSLSASVGDRVTITCRASQSINTYLNWYQHKPGKAPKLLIYAASSLQSGVPSRFSGSGSGTDFTLTISSLQPEDFATYYCQQSFSPLTFGGGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2372 - protein, 486 aa, Artificial Sequence
  source: /note="Description of Artificial Sequence: Synthetic Chimeric Antigen Receptor sequence"
MALPVTALLLPLALLLHAARPQVQLVESGGGLVQPGGSLRLSCAASGFTFSSYWMHWVRQVPGKGLVWVSRINTDGSTTTYADSVEGRFTISRDNAKNTLYLQMNSLRDDDTAVYYCVGGHWAVWGQGTTVTVSSGGGGSGGGGSGGGGSGGGGSDIQMTQSPSTLSASVGDRVTITCRASQSISDRLAWYQQKPGKAPKLLIYKASSLESGVPSRFSGSGSGTEFTLTISSLQPDDFAVYYCQQYGHLPMYTFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2373 - protein, 485 aa, Artificial Sequence
  source: /note="Description of Artificial Sequence: Synthetic Chimeric Antigen Receptor sequence"
MALPVTALLLPLALLLHAARPQVQLVQSGAEVEKPGASVKVSCKASGYTFTDYYMHWVRQAPGQGLEWMGWINPNSGGTNYAQKFQGRVTMTRDTSISTAYMELSRLRSDDTAVYYCASGWDFDYWGQGTLVTVSSGGGGSGGGGSGGGGSGGGGSDIVMTQSPSSLSASVGDRVTITCRASQSIRYYLSWYQQKPGKAPKLLIYTASILQNGVPSRFSGSGSGTDFTLTISSLQPEDFATYYCLQTYTTPDFGPGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2374 - protein, 497 aa, Artificial Sequence
  source: /note="Description of Artificial Sequence: Synthetic Chimeric Antigen Receptor sequence"
MALPVTALLLPLALLLHAARPQVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCARYRLIAVAGDYYYYGMDVWGQGTMVTVSSGGGGSGGGGSGGGGSGGGGSDIQMTQSPSSVSASVGDRVTITCRASQGVGRWLAWYQQKPGTAPKLLIYAASTLQSGVPSRFSGSGSGTDFTLTINNLQPEDFATYYCQQANSFPLTFGGGTRLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2375 - protein, 494 aa, Artificial Sequence
  source: /note="Description of Artificial Sequence: Synthetic Chimeric Antigen Receptor sequence"
MALPVTALLLPLALLLHAARPQVQLVQSGGGVVQPGRSLRLSCAASGFTFSSYAMHWVRQAPGKGLEWVAVISYDGSNKYYADSVKGRFTISRDNSKNTLYLQMNSLRAEDTAVYYCARWKVSSSSPAFDYWGQGTLVTVSSGGGGSGGGGSGGGGSGGGGSEIVLTQSPATLSLSPGERAILSCRASQSVYTKYLGWYQQKPGQAPRLLIYDASTRATGIPDRFSGSGSGTDFTLTINRLEPEDFAVYYCQHYGGSPLITFGQGTRLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2376 - protein, 490 aa, Artificial Sequence
  source: /note="Description of Artificial Sequence: Synthetic Chimeric Antigen Receptor sequence"
MALPVTALLLPLALLLHAARPQVQLQQSGAEVKKPGASVKVSCKTSGYPFTGYSLHWVRQAPGQGLEWMGWINPNSGGTNYAQKFQGRVTMTRDTSISTAYMELSRLRSDDTAVYYCARDHYGGNSLFYWGQGTLVTVSSGGGGSGGGGSGGGGSGGGGSDIQLTQSPSSISASVGDTVSITCRASQDSGTWLAWYQQKPGKAPNLLMYDASTLEDGVPSRFSGSASGTEFTLTVNRLQPEDSATYYCQQYNSYPLTFGGGTKVDIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2377 - protein, 492 aa, Artificial Sequence
  source: /note="Description of Artificial Sequence: Synthetic Chimeric Antigen Receptor sequence"
MALPVTALLLPLALLLHAARPQVQLVQSGAEVKKPGASVEVSCKASGYTFTSYYMHWVRQAPGQGLEWMGIINPSGGSTGYAQKFQGRVTMTRDTSTSTVHMELSSLRSEDTAVYYCARGGYSSSSDAFDIWGQGTMVTVSSGGGGSGGGGSGGGGSGGGGSDIQMTQSPPSLSASVGDRVTITCRASQDISSALAWYQQKPGTPPKLLIYDASSLESGVPSRFSGSGSGTDFTLTISSLQPEDFATYYCQQFSSYPLTFGGGTRLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2378 - protein, 356 aa, Artificial Sequence
  source: /note="Description of Artificial Sequence: Synthetic Chimeric Antigen Receptor sequence"
MALPVTALLLPLALLLHAARPPGWFLDSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLRAELRVTERRAEVPTARPSPSPRPAGQFQTLVTTTPAPRPPTPAPTIASQPLSLRPEACRPAAGGAVHTRGLDFACDIYIWAPLAGTCGVLLLSLVITLYCKRGRKKLLGGGGSGGGGSASRILWHEMWHEGLEEASRLYFGERNVKGMFEVLEPLHAMMERGPQTLKETSFNQAYGRDLMEAQEWCRKYMKSGNVKDLLQAWDLYYHVFRRISKTS

SEQ ID NO: 2379 - protein, 1701 aa, Artificial Sequence
  source: /note="Description of Artificial Sequence: Synthetic Chimeric Antigen Receptor sequence"
MSLPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITKAGGGGSGGGGSGGGGSGGGGSEVKLQESGPGLVAPSQSLSVTCTVSGVSLPDYGVSWIRQPPRKGLEWLGVIWGSETTYYNSALKSRLTMKDNSKSQVFLKMNSLQTDDTAIYYCAKHYYYGGSYAMDYWGQGTSVTVSSDPTTTPAPRPPTPAPTIASQPLSLRPEACRPAAGGAVHTRGLDFACDIFVWLVWGGVLACYSLLVTVAFIIFWVRRVKFSRSADAPAYQQGQQLYNELNLGRREEYDVLDKRRGRDPEMGGKPRRKNPQEGLYNELQKDMAEAYSEIGMKGERRRGKGHDGLYQGLSTATKDTYDALHMQALPPRRAEGRGSLLTCGDVEENPGPMAVPTQVLGLLLLWLTDARCDIQMTQSPSSLSASVGDRVTITCRASEDIYFNLVWYQQKPGKAPKLLIYDTNRLADGVPSRFSGSGSGTQYTLTISSLQPEDFATYYCQHYKNYPLTFGQGTKLEIKRSGGGGSGGGGSGGGGSGGGGSRSEVQLVESGGGLVQPGGSLRLSCAASGFTLSNYGMHWIRQAPGKGLEWVSSISLNGGSTYYRDSVKGRFTISRDNAKSTLYLQMNSLRAEDTAVYYCAAQDAYTGGYFDYWGQGTLVTVSSMDPAEPKSPDKTHTCPPCPAPPVAGPSVFLFPPKPKDTLMIARTPEVTCVWDVSHEDPEVKFNWYVDGVEVHNAKTKPREEQYNSTYRWSVLTVLHQDWLNGKEYKCKVSNKALPAPIEKTISKAKGQPREPQVYTLPPSRDELTNQVSLTCLVKGFYPSDIAVEWESNGQPENNYKTTPPVLDSDGSFFLYSKLTVDKSRWQQGNVFSCSVMHEALHNHYTQKSLSLSPGKKDPKALIAFLAFLIIVTSIALLWLYKIYDLHKKRSCNLDEQQELVERDDEKQLMNVEPIHADILLETYKRKIADEGRLFLAEFQSIPRVFSKFPIEARKPFNQNKNRYVDILPYDYNRVELSEINGDAGSNYINASYIDGFKEPRKYIAAQGPRDETVDDFWRMIWEQKATVIVMVTRCEEGNRNKCAEYWPSMEEGTRAFGDVWKINQHKRCPDYIIQKLNIVNKKEKATGREVTHIQFTSWPDHGVPEDPHLLLKLRRRVNAFSNFFSGPIWHCSAGVGRTGTYIGIDAMLEGLEAENKVDVYGYWKLRRQRCLMVQVEAQYILIHQALVEYNQFGETEVNLSELHPYLHNMKKRDPPSEPSPLEAEFQRLPSYRSWRTQHIGNQEENKSKNRNSNVIPYDYNRVPLKHELEMSKESEHDSDESSDDDSDSEEPSKYINASFIMSYWKPEVMIAAQGPLKETIGDFWQMIFQRKVKVIVMLTELKHGDQEICAQYWGEGKQTYGDIEVDLDTDKSSTYTLRVFELRHSKRKDSRTVYQYQYTNWSVEQLPAEPKELISMIQWKQKLPQKNSSEGNKHHKSTPLLIHCRDGSQQTGIFCALLNLLESAETEEWDIFQWKALRKARPGMVSTFEQYQFLYDVIASTYPAQNGQVKKNNHQEDKIEFDNEVDKVKQDANCVNPLGAPEKLPEAKEQAEGSEPTSGTEGPEHSVNGPASPALNQGS

SEQ ID NO: 2380 - protein, 378 aa, Artificial Sequence
  source: /note="Description of Artificial Sequence: Synthetic Chimeric Antigen Receptor sequence"
MALPVTALLLPLALLLHAARPGSGSGAQAAEVQLQQSGPELVKPGTSVRISCKTSGYTFTEYTIHWVKQSHGKSLEWIGNINPNNGGTTYNQKFEDKATLTVDKSSSTAYMELRSLTSEDSAVYYCAAGWNFDYWGQGTTVTVSSGGGGSGGGGSGGGGSDIVMTQSHKFMSTSVGDRVSIICKASQDVGTAVDWYQQKPGQSPKLLIYWASTRHTGVPDRFTGSGSGTDFTLTITNVQSEDLADYFCQQYNSYPLTFGAGTMLDLKRAAARSDPASGAGSGSGSAVKEGPPSEHSGISRNAIIFLVLGILVFLILLGIGIYFYWSKCSREVLWHCHLCPSSTEHASASANGHVSYSAVSRENSSSQDPQTEGTRSHG

SEQ ID NO: 2381 - protein, 386 aa, Artificial Sequence
  source: /note="Description of Artificial Sequence: Synthetic Chimeric Antigen Receptor sequence"
MALPVTALLLPLALLLHAARPGSGSGAQAAEVQLQQSGPELVKPGTSVRISCKTSGYTFTEYTIHWVKQSHGKSLEWIGNINPNNGGTTYNQKFEDKATLTVDKSSSTAYMELRSLTSEDSAVYYCAAGWNFDYWGQGTTVTVSSGGGGSGGGGSGGGGSDIVMTQSHKFMSTSVGDRVSIICKASQDVGTAVDWYQQKPGQSPKLLIYWASTRHTGVPDRFTGSGSGTDFTLTITNVQSEDLADYFCQQYNSYPLTFGAGTMLDLKRAAARSDPASGAGSGSGSAVQAPSSSPMGIIVAVVTGIAVAAIVAAVVALIYCRKKRISALPGYPECREMGETLPEKPANPTNPDEADKVGAENTITYSLLMHPDALEEPDDQNRISHG

SEQ ID NO: 2382 - protein, 404 aa, Artificial Sequence
  source: /note="Description of Artificial Sequence: Synthetic Chimeric Antigen Receptor sequence"
MALPVTALLLPLALLLHAARPGSGSGAQAAEVQLQQSGPELVKPGTSVRISCKTSGYTFTEYTIHWVKQSHGKSLEWIGNINPNNGGTTYNQKFEDKATLTVDKSSSTAYMELRSLTSEDSAVYYCAAGWNFDYWGQGTTVTVSSGGGGSGGGGSGGGGSDIVMTQSHKFMSTSVGDRVSIICKASQDVGTAVDWYQQKPGQSPKLLIYWASTRHTGVPDRFTGSGSGTDFTLTITNVQSEDLADYFCQQYNSYPLTFGAGTMLDLKRAAARSDPASGAGSGSGSASFRALPHAWSDPSDPLPVSVTGNSRYLHALIGTSVVIIPFAILLFFLLHRWCANKKNAVVMDQEPAGNRTVNREDSDEQDPQEVTYAQLNHCVFTQRKITRPSQRPKTPPTDTSVSHG

SEQ ID NO: 2383 - protein, 405 aa, Artificial Sequence
  source: /note="Description of Artificial Sequence: Synthetic Chimeric Antigen Receptor sequence"
MALPVTALLLPLALLLHAEVQLQQSGPELVKPGTSVRISCKTSGYTFTEYTIHWVKQSHGKSLEWIGNINPNNGGTTYNQKFEDKATLTVDKSSSTAYMELRSLTSEDSAVYYCAAGWNFDYWGQGTTVTVSSGGGGSGGGGSGGGGSDIVMTQSHKFMSTSVGDRVSIICKASQDVGTAVDWYQQKPGQSPKLLIYWASTRHTGVPDRFTGSGSGTDFTLTITNVQSEDLADYFCQQYNSYPLTFGAGTMLDLKRAAATERRAEVPTAHPSPSPRPAGQFQTLVVGVVGGLLGSLVLLVWVLAVICSRAARGTIGARRTGQPLKEDPSAVPVFSVDYGELDFQWREKTPEPPVPCVPEQTEYATIVFPSGMGTSSPARRGSADGPRSAQPLRPEDGHCSWPLSH

SEQ ID NO: 2384 - protein, 409 aa, Artificial Sequence
  source: /note="Description of Artificial Sequence: Synthetic Chimeric Antigen Receptor sequence"
MALPVTALLLPLALLLHAARPGSGSGAQAAEVQLQQSGPELVKPGTSVRISCKTSGYTFTEYTIHWVKQSHGKSLEWIGNINPNNGGTTYNQKFEDKATLTVDKSSSTAYMELRSLTSEDSAVYYCAAGWNFDYWGQGTTVTVSSGGGGSGGGGSGGGGSDIVMTQSHKFMSTSVGDRVSIICKASQDVGTAVDWYQQKPGQSPKLLIYWASTRHTGVPDRFTGSGSGTDFTLTITNVQSEDLADYFCQQYNSYPLTFGAGTMLDLKRAAARSDPASGAGSGSGSALFVHWKPEGRAGGVLGAVWGASITTLVFLCVCFIFRVKTRRKKAAQPVQNTDDVNPVMVSGSRGHQHQFQTGIVSDHPAEAGPISEDEQELHYAVLHFHKVQPQEPKVTDTEYSEIKIHKSHG

SEQ ID NO: 2385 - protein, 410 aa, Artificial Sequence
  source: /note="Description of Artificial Sequence: Synthetic Chimeric Antigen Receptor sequence"
MALPVTALLLPLALLLHAARPGSGSGAQAAEVQLQQSGPELVKPGTSVRISCKTSGYTFTEYTIHWVKQSHGKSLEWIGNINPNNGGTTYNQKFEDKATLTVDKSSSTAYMELRSLTSEDSAVYYCAAGWNFDYWGQGTTVTVSSGGGGSGGGGSGGGGSDIVMTQSHKFMSTSVGDRVSIICKASQDVGTAVDWYQQKPGQSPKLLIYWASTRHTGVPDRFTGSGSGTDFTLTITNVQSEDLADYFCQQYNSYPLTFGAGTMLDLKRAAARSDPASGAGSGSGSAGPDGYRRDLMTAGVLWGLFGVLGFTGVALLLYALFHKISGESSATNEPRGASRPNPQEFTYSSPTPDMEELQPVYVNVGSVDVDVVYSQVWSMQQPESSANIRTLLENKDSQVIYSSVKKSSHG

SEQ ID NO: 2386 - protein, 412 aa, Artificial Sequence
  source: /note="Description of Artificial Sequence: Synthetic Chimeric Antigen Receptor sequence"
MALPVTALLLPLALLLHAARPGSGSGAQAAEVQLQQSGPELVKPGTSVRISCKTSGYTFTEYTIHWVKQSHGKSLEWIGNINPNNGGTTYNQKFEDKATLTVDKSSSTAYMELRSLTSEDSAVYYCAAGWNFDYWGQGTTVTVSSGGGGSGGGGSGGGGSDIVMTQSHKFMSTSVGDRVSIICKASQDVGTAVDWYQQKPGQSPKLLIYWASTRHTGVPDRFTGSGSGTDFTLTITNVQSEDLADYFCQQYNSYPLTFGAGTMLDLKRAAARSDPASGAGSGSGSAPGHIRLYVVEKENLPVFPVWVVVGIVTAVVLGLTLLISMILAVLYRRKNSKRDYTGCSTSESLSPVKQAPRKSPSDTEGLVKSLPSGSHQGPVIYAQLDHSGGHHSDKINKSESVVYADIRKNSHG

SEQ ID NO: 2387 - protein, 416 aa, Artificial Sequence
  source: /note="Description of Artificial Sequence: Synthetic Chimeric Antigen Receptor sequence"
MALPVTALLLPLALLLHAARPGSGSGAQAAEVQLQQSGPELVKPGTSVRISCKTSGYTFTEYTIHWVKQSHGKSLEWIGNINPNNGGTTYNQKFEDKATLTVDKSSSTAYMELRSLTSEDSAVYYCAAGWNFDYWGQGTTVTVSSGGGGSGGGGSGGGGSDIVMTQSHKFMSTSVGDRVSIICKASQDVGTAVDWYQQKPGQSPKLLIYWASTRHTGVPDRFTGSGSGTDFTLTITNVQSEDLADYFCQQYNSYPLTFGAGTMLDLKRAAARSDPASGAGSGSGSALQSKATSGVTQGVVGGAGATALVFLSFCVIFVVVRSCRKKSARPAAGVGDTGIEDANAVRGSASQGPLTEPWAEDSPPDQPPPASARSSVGEGELQYASLSFQMVKPWDSRGQEATDTEYSEIKIHRSHG

SEQ ID NO: 2388 - protein, 419 aa, Artificial Sequence
  source: /note="Description of Artificial Sequence: Synthetic Chimeric Antigen Receptor sequence"
MALPVTALLLPLALLLHAARPGSGSGAQAAEVQLQQSGPELVKPGTSVRISCKTSGYTFTEYTIHWVKQSHGKSLEWIGNINPNNGGTTYNQKFEDKATLTVDKSSSTAYMELRSLTSEDSAVYYCAAGWNFDYWGQGTTVTVSSGGGGSGGGGSGGGGSDIVMTQSHKFMSTSVGDRVSIICKASQDVGTAVDWYQQKPGQSPKLLIYWASTRHTGVPDRFTGSGSGTDFTLTITNVQSEDLADYFCQQYNSYPLTFGAGTMLDLKRAAARSDPASGAGSGSGSAMPSTGGDSCPFCLKLLLPGLLLLLVVIILILAFWVLPKYKTRKAMRNNVPRDRGDTAMEVGIYANILEKQAKEESVPEVGSRPCVSTAQDEAKHSQELQYATPVFQEVAPREQEACDSYKSGYVYSELNFSHG

SEQ ID NO: 2389 - protein, 420 aa, Artificial Sequence
  source: /note="Description of Artificial Sequence: Synthetic Chimeric Antigen Receptor sequence"
MALPVTALLLPLALLLHAARPGSGSGAQAAEVQLQQSGPELVKPGTSVRISCKTSGYTFTEYTIHWVKQSHGKSLEWIGNINPNNGGTTYNQKFEDKATLTVDKSSSTAYMELRSLTSEDSAVYYCAAGWNFDYWGQGTTVTVSSGGGGSGGGGSGGGGSDIVMTQSHKFMSTSVGDRVSIICKASQDVGTAVDWYQQKPGQSPKLLIYWASTRHTGVPDRFTGSGSGTDFTLTITNVQSEDLADYFCQQYNSYPLTFGAGTMLDLKRAAARSDPASGAGSGSGSALQQEYTGKMRPVSGVLLGAVGGAGATALVFLSFCVIFIVVRSCRKKSARPAADVGDIGMKDANTIRGSASQGNLTESWADDNPRHHGLAAHSSGEEREIQYAPLSFHKGEPQDLSGQEATNNEYSEIKIPKSHG

SEQ ID NO: 2390 - protein, 422 aa, Artificial Sequence
  source: /note="Description of Artificial Sequence: Synthetic Chimeric Antigen Receptor sequence"
MALPVTALLLPLALLLHAARPGSGSGAQAAEVQLQQSGPELVKPGTSVRISCKTSGYTFTEYTIHWVKQSHGKSLEWIGNINPNNGGTTYNQKFEDKATLTVDKSSSTAYMELRSLTSEDSAVYYCAAGWNFDYWGQGTTVTVSSGGGGSGGGGSGGGGSDIVMTQSHKFMSTSVGDRVSIICKASQDVGTAVDWYQQKPGQSPKLLIYWASTRHTGVPDRFTGSGSGTDFTLTITNVQSEDLADYFCQQYNSYPLTFGAGTMLDLKRAAARSDPASGAGSGSGSALQNEYTGKMRPISGVTLGAFGGAGATALVFLYFCIIFVVVRSCRKKSARPAVGVGDTGMEDANAVRGSASQGPLIESPADDSPPHHAPPALATPSPEEGEIQYASLSFHKARPQYPQEQEAIGYEYSEINIPKSHG

SEQ ID NO: 2391 - protein, 425 aa, Artificial Sequence
  source: /note="Description of Artificial Sequence: Synthetic Chimeric Antigen Receptor sequence"
MALPVTALLLPLALLLHAARPGSGSGAQAAEVQLQQSGPELVKPGTSVRISCKTSGYTFTEYTIHWVKQSHGKSLEWIGNINPNNGGTTYNQKFEDKATLTVDKSSSTAYMELRSLTSEDSAVYYCAAGWNFDYWGQGTTVTVSSGGGGSGGGGSGGGGSDIVMTQSHKFMSTSVGDRVSIICKASQDVGTAVDWYQQKPGQSPKLLIYWASTRHTGVPDRFTGSGSGTDFTLTITNVQSEDLADYFCQQYNSYPLTFGAGTMLDLKRAAARSDPASGAGSGSGSALNVTYVPQNPTTGIFPGDGSGKQETRAGVVHGAIGGAGVTALLALCLCLIFFIVKTHRRKAARTAVGRNDTHPTTGSASPKHQKKSKLHGPTETSSCSGAAPTVEMDEELHYASLNFHGMNPSKDTSTEYSEVRTQSHG

SEQ ID NO: 2392 - protein, 425 aa, Artificial Sequence
  source: /note="Description of Artificial Sequence: Synthetic Chimeric Antigen Receptor sequence"
MALPVTALLLPLALLLHAARPGSGSGAQAAEVQLQQSGPELVKPGTSVRISCKTSGYTFTEYTIHWVKQSHGKSLEWIGNINPNNGGTTYNQKFEDKATLTVDKSSSTAYMELRSLTSEDSAVYYCAAGWNFDYWGQGTTVTVSSGGGGSGGGGSGGGGSDIVMTQSHKFMSTSVGDRVSIICKASQDVGTAVDWYQQKPGQSPKLLIYWASTRHTGVPDRFTGSGSGTDFTLTITNVQSEDLADYFCQQYNSYPLTFGAGTMLDLKRAAARSDPASGAGSGSGSAPYEWSNSSDPLLVSVTGNPSNSWPSPTEPSSETGNPRHLHVLIGTSVVIILFILLLFFLLHRWCCNKKNAVVMDQEPAGNRTVNREDSDEQDPQEVTYAQLNHCVFTQRKITRPSQRPKTPPTDIIVYTELPNAEPSHG

SEQ ID NO: 2393 - protein, 427 aa, Artificial Sequence
  source: /note="Description of Artificial Sequence: Synthetic Chimeric Antigen Receptor sequence"
MALPVTALLLPLALLLHAARPGSGSGAQAAEVQLQQSGPELVKPGTSVRISCKTSGYTFTEYTIHWVKQSHGKSLEWIGNINPNNGGTTYNQKFEDKATLTVDKSSSTAYMELRSLTSEDSAVYYCAAGWNFDYWGQGTTVTVSSGGGGSGGGGSGGGGSDIVMTQSHKFMSTSVGDRVSIICKASQDVGTAVDWYQQKPGQSPKLLIYWASTRHTGVPDRFTGSGSGTDFTLTITNVQSEDLADYFCQQYNSYPLTFGAGTMLDLKRAAARSDPASGAGSGSGSALNFTVPTGARSNHLTSGVIEGLLSTLGPATVALLFCYGLKRKIGRRSARDPLRSLPSPLPQEFTYLNSPTPGQLQPIYENVNVVSGDEVYSLAYYNQPEQESVAAETLGTHMEDKVSLDIYSRLRKANITDVDYEDAMSHG

SEQ ID NO: 2394 - protein, 430 aa, Artificial Sequence
  source: /note="Description of Artificial Sequence: Synthetic Chimeric Antigen Receptor sequence"
MALPVTALLLPLALLLHAARPGSGSGAQAAEVQLQQSGPELVKPGTSVRISCKTSGYTFTEYTIHWVKQSHGKSLEWIGNINPNNGGTTYNQKFEDKATLTVDKSSSTAYMELRSLTSEDSAVYYCAAGWNFDYWGQGTTVTVSSGGGGSGGGGSGGGGSDIVMTQSHKFMSTSVGDRVSIICKASQDVGTAVDWYQQKPGQSPKLLIYWASTRHTGVPDRFTGSGSGTDFTLTITNVQSEDLADYFCQQYNSYPLTFGAGTMLDLKRAAARSDPASGAGSGSGSAVTVRETPGNRDGLVAAGATGGLLSALLLAVALLFHCWRRRKSGVGFLGDETRLPPAPGPGESSHSICPAQVELQSLYVDVHPKKGDLVYSEIQTTQLGEEEEANTSRTLLEDKDVSVVYSEVKTQHPDNSAGKISSKDEESSHG

SEQ ID NO: 2395 - protein, 432 aa, Artificial Sequence
  source: /note="Description of Artificial Sequence: Synthetic Chimeric Antigen Receptor sequence"
MALPVTALLLPLALLLHAARPGSGSGAQAAEVQLQQSGPELVKPGTSVRISCKTSGYTFTEYTIHWVKQSHGKSLEWIGNINPNNGGTTYNQKFEDKATLTVDKSSSTAYMELRSLTSEDSAVYYCAAGWNFDYWGQGTTVTVSSGGGGSGGGGSGGGGSDIVMTQSHKFMSTSVGDRVSIICKASQDVGTAVDWYQQKPGQSPKLLIYWASTRHTGVPDRFTGSGSGTDFTLTITNVQSEDLADYFCQQYNSYPLTFGAGTMLDLKRAAARSDPASGAGSGSGSALYITGLTANRSGPFATGVAGGLLSIAGLAAGALLLYCWLSRKAGRKPASDPARSPPDSDSQEPTYHNVPAWEELQPVYTNANPRGENVVYSEVRIIQEKKKHAVASDPRHLRNKGSPIIYSEVKVASTPVSGSLFLASSAPHRSHG

SEQ ID NO: 2396 - protein, 432 aa, Artificial Sequence
  source: /note="Description of Artificial Sequence: Synthetic Chimeric Antigen Receptor sequence"
MALPVTALLLPLALLLHAARPGSGSGAQAAEVQLQQSGPELVKPGTSVRISCKTSGYTFTEYTIHWVKQSHGKSLEWIGNINPNNGGTTYNQKFEDKATLTVDKSSSTAYMELRSLTSEDSAVYYCAAGWNFDYWGQGTTVTVSSGGGGSGGGGSGGGGSDIVMTQSHKFMSTSVGDRVSIICKASQDVGTAVDWYQQKPGQSPKLLIYWASTRHTGVPDRFTGSGSGTDFTLTITNVQSEDLADYFCQQYNSYPLTFGAGTMLDLKRAAARSDPASGAGSGSGSAPYEWSKSSDPLLVSVTGNPSNSWPSPTEPSSKTGNPRHLHILIGTSVVIILFILLFFLLHRWCSNKKNAAVMDQESAGNRTANSEDSDEQDPQEVTYTQLNHCVFTQRKITRPSQRPKTPPTDIIVYTELPNAESRSKVVSCPSHG

SEQ ID NO: 2397 - protein, 432 aa, Artificial Sequence
  source: /note="Description of Artificial Sequence: Synthetic Chimeric Antigen Receptor sequence"
MALPVTALLLPLALLLHAARPGSGSGAQAAEVQLQQSGPELVKPGTSVRISCKTSGYTFTEYTIHWVKQSHGKSLEWIGNINPNNGGTTYNQKFEDKATLTVDKSSSTAYMELRSLTSEDSAVYYCAAGWNFDYWGQGTTVTVSSGGGGSGGGGSGGGGSDIVMTQSHKFMSTSVGDRVSIICKASQDVGTAVDWYQQKPGQSPKLLIYWASTRHTGVPDRFTGSGSGTDFTLTITNVQSEDLADYFCQQYNSYPLTFGAGTMLDLKRAAARSDPASGAGSGSGSAPYEWSNSSDPLLVSVIGNPSNSWPSPTEPSSKTGNPRHLHILIGTSVVIILFILLFFLLHRWCSNKKNAAVMDQESAGNRTANSEDSDEQDPQEVTYTQLNHCVFTQRKITRPSQRPKTPPTDIIVYAELPNAESRSKVVSCPSHG

SEQ ID NO: 2398 - protein, 432 aa, Artificial Sequence
  source: /note="Description of Artificial Sequence: Synthetic Chimeric Antigen Receptor sequence"
MALPVTALLLPLALLLHAARPGSGSGAQAAEVQLQQSGPELVKPGTSVRISCKTSGYTFTEYTIHWVKQSHGKSLEWIGNINPNNGGTTYNQKFEDKATLTVDKSSSTAYMELRSLTSEDSAVYYCAAGWNFDYWGQGTTVTVSSGGGGSGGGGSGGGGSDIVMTQSHKFMSTSVGDRVSIICKASQDVGTAVDWYQQKPGQSPKLLIYWASTRHTGVPDRFTGSGSGTDFTLTITNVQSEDLADYFCQQYNSYPLTFGAGTMLDLKRAAARSDPASGAGSGSGSAERRAEVPTAHPSPSPRPAGQFQTLVVGVVGGLLGSLVLLVWVLAVICSRAARGTIGARRTGQPLKEDPSAVPVFSVDYGELDFQWREKTPEPPVPCVPEQTEYATIVFPSGMGTSSPARRGSADGPRSAQPLRPEDGHCSWPLSHG

SEQ ID NO: 2399 - protein, 433 aa, Artificial Sequence
  source: /note="Description of Artificial Sequence: Synthetic Chimeric Antigen Receptor sequence"
MALPVTALLLPLALLLHAARPGSGSGAQAAEVQLQQSGPELVKPGTSVRISCKTSGYTFTEYTIHWVKQSHGKSLEWIGNINPNNGGTTYNQKFEDKATLTVDKSSSTAYMELRSLTSEDSAVYYCAAGWNFDYWGQGTTVTVSSGGGGSGGGGSGGGGSDIVMTQSHKFMSTSVGDRVSIICKASQDVGTAVDWYQQKPGQSPKLLIYWASTRHTGVPDRFTGSGSGTDFTLTITNVQSEDLADYFCQQYNSYPLTFGAGTMLDLKRAAARSDPASGAGSGSGSAPYEWSDPSDPLLVSVTGNPSSSWPSPTEPSSKSGNPRHLHILIGTSVVIILFILLLFFLLHLWCSNKKNAAVMDQEPAGNRTANSEDSDEQDPEEVTYAQLDHCVFTQRKITRPSQRPKTPPTDTILYTELPNAKPRSKVVSCPSHG

SEQ ID NO: 2400 - protein, 434 aa, Artificial Sequence
  source: /note="Description of Artificial Sequence: Synthetic Chimeric Antigen Receptor sequence"
QVQLQQSGAELVRPGASVTLSCKASGYTFSDYEMHWVIQTPVHGLEWIGAIDPETGGTAYNQKFKGKAILTADKSSSTAYMELRSLTSEDSAVYYCTGYYDYDSFTYWGQGTLVTVSAGGGGSGGGGSGGGGSDIVMTQSQKIMSTTVGDRVSITCKASQNVDAAVAWYQQKPGQSPKLLIYSASNRYTGVPDRFTGSGSGTDFTLTISNMQSEDLADYFCQQYDIYPYTFGGGTKLEIKGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2401 - protein, 436 aa, Artificial Sequence
  source: /note="Description of Artificial Sequence: Synthetic Chimeric Antigen Receptor sequence"
MALPVTALLLPLALLLHAARPGSGSGAQAAEVQLQQSGPELVKPGTSVRISCKTSGYTFTEYTIHWVKQSHGKSLEWIGNINPNNGGTTYNQKFEDKATLTVDKSSSTAYMELRSLTSEDSAVYYCAAGWNFDYWGQGTTVTVSSGGGGSGGGGSGGGGSDIVMTQSHKFMSTSVGDRVSIICKASQDVGTAVDWYQQKPGQSPKLLIYWASTRHTGVPDRFTGSGSGTDFTLTITNVQSEDLADYFCQQYNSYPLTFGAGTMLDLKRAAARSDPASGAGSGSGSAVRVILAPWKKGLIAVVIIGVIIALLIIAAKCYFLRKAKAKQMPVEMSRPAVPLLNSNNEKMSDPNMEANSHYGHNDDVGNHAMKPINDNKEPLNSDVQYTEVQVSSAESHKDLGKKDTETVYSEVRKAVPDAVESRYSRTEGSLDGTSHG

SEQ ID NO: 2402 - protein, 442 aa, Artificial Sequence
  source: /note="Description of Artificial Sequence: Synthetic Chimeric Antigen Receptor sequence"
MALPVTALLLPLALLLHAARPGSGSGAQAAEVQLQQSGPELVKPGTSVRISCKTSGYTFTEYTIHWVKQSHGKSLEWIGNINPNNGGTTYNQKFEDKATLTVDKSSSTAYMELRSLTSEDSAVYYCAAGWNFDYWGQGTTVTVSSGGGGSGGGGSGGGGSDIVMTQSHKFMSTSVGDRVSIICKASQDVGTAVDWYQQKPGQSPKLLIYWASTRHTGVPDRFTGSGSGTDFTLTITNVQSEDLADYFCQQYNSYPLTFGAGTMLDLKRAAARSDPASGAGSGSGSAQAVTTTTQRPSSMTTTWRLSSTTTTTGLRVTQGKRRSDSWHISLETAVGVAVAVTVLGIMILGLICLLRWRRRKGQQRTKATTPAREPFQNTEEPYENIRNEGQNTDPKLNPKDDGIVYASLALSSSTSPKAPPSHRPLKSPQNETLYSVLKASHG

SEQ ID NO: 2403 - protein, 444 aa, Artificial Sequence
  source: /note="Description of Artificial Sequence: Synthetic Chimeric Antigen Receptor sequence"
MALPVTALLLPLALLLHAARPGSGSGAQAAEVQLQQSGPELVKPGTSVRISCKTSGYTFTEYTIHWVKQSHGKSLEWIGNINPNNGGTTYNQKFEDKATLTVDKSSSTAYMELRSLTSEDSAVYYCAAGWNFDYWGQGTTVTVSSGGGGSGGGGSGGGGSDIVMTQSHKFMSTSVGDRVSIICKASQDVGTAVDWYQQKPGQSPKLLIYWASTRHTGVPDRFTGSGSGTDFTLTITNVQSEDLADYFCQQYNSYPLTFGAGTMLDLKRAAARSDPASGAGSGSGSAPCVWSNSSDPLLVSVTGNPSSSWPSPTEPSSKSGICRHLHVLIGTSVVIFLFILLLFFLLYRWCSNKKNAAVMDQEPAGDRTVNRQDSDEQDPQEVTYAQLDHCVFIQRKISRPSQRPKTPLTDTSVYTELPNAEPRSKVVSCPRAPQSGLEGVFSHG

SEQ ID NO: 2404 - protein, 444 aa, Artificial Sequence
  source: /note="Description of Artificial Sequence: Synthetic Chimeric Antigen Receptor sequence"
MALPVTALLLPLALLLHAARPGSGSGAQAAEVQLQQSGPELVKPGTSVRISCKTSGYTFTEYTIHWVKQSHGKSLEWIGNINPNNGGTTYNQKFEDKATLTVDKSSSTAYMELRSLTSEDSAVYYCAAGWNFDYWGQGTTVTVSSGGGGSGGGGSGGGGSDIVMTQSHKFMSTSVGDRVSIICKASQDVGTAVDWYQQKPGQSPKLLIYWASTRHTGVPDRFTGSGSGTDFTLTITNVQSEDLADYFCQQYNSYPLTFGAGTMLDLKRAAARSDPASGAGSGSGSALQNEGTGTSRPVSQVTLAAVGGAGATALAFLSFCIIFIIVRSCRKKSARPAAGVGDTGMEDAKAIRGSASQGPLTESWKDGNPLKKPPPAVAPSSGEEGELHYATLSFHKVKPQDPQGQEATDSEYSEIKIHKRETAETQACLRNHNPSSKEVRGSHG

SEQ ID NO: 2405 - protein, 460 aa, Artificial Sequence
  source: /note="Description of Artificial Sequence: Synthetic Chimeric Antigen Receptor sequence"
MALPVTALLLPLALLLHAARPGSGSGAQAAEVQLQQSGPELVKPGTSVRISCKTSGYTFTEYTIHWVKQSHGKSLEWIGNINPNNGGTTYNQKFEDKATLTVDKSSSTAYMELRSLTSEDSAVYYCAAGWNFDYWGQGTTVTVSSGGGGSGGGGSGGGGSDIVMTQSHKFMSTSVGDRVSIICKASQDVGTAVDWYQQKPGQSPKLLIYWASTRHTGVPDRFTGSGSGTDFTLTITNVQSEDLADYFCQQYNSYPLTFGAGTMLDLKRAAARSDPASGAGSGSGSAGTSRNRTGLTAAGITGLVLSILVLAAAAALLHYARARRKPGGLSATGTSSHSPSECQEPSSSRPSRIDPQEPTHSKPLAPMELEPMYSNANPGDSNPIYSQIWSIQHTKENSANCPMMHQEHEELTVLYSELKKTHPDDSAGEASSRGRAHEEDDEENYENVPRVLLASDHSHG

SEQ ID NO: 2406 - protein, 461 aa, Artificial Sequence
  source: /note="Description of Artificial Sequence: Synthetic Chimeric Antigen Receptor sequence"
MALPVTALLLPLALLLHAARPGSGSGAQAAEVQLQQSGPELVKPGTSVRISCKTSGYTFTEYTIHWVKQSHGKSLEWIGNINPNNGGTTYNQKFEDKATLTVDKSSSTAYMELRSLTSEDSAVYYCAAGWNFDYWGQGTTVTVSSGGGGSGGGGSGGGGSDIVMTQSHKFMSTSVGDRVSIICKASQDVGTAVDWYQQKPGQSPKLLIYWASTRHTGVPDRFTGSGSGTDFTLTITNVQSEDLADYFCQQYNSYPLTFGAGTMLDLKRAAARSDPASGAGSGSGSAGPSGDPSLSPTGSTPTPGPEDQPLTPTGLDPQSGLGRHLGVVTGVSVAFVLLLFLLLFLLLRHRHQSKHRTSAHFYRPAGAAGPEPKDQGLQKRASPVADIQEEILNAAVKDTQPKDGVEMDARAAASEAPQDVTYAQLHSLTLRREATEPPPSQEREPPAEPSIYAPLAIHSHG

SEQ ID NO: 2407 - protein, 464 aa, Artificial Sequence
  source: /note="Description of Artificial Sequence: Synthetic Chimeric Antigen Receptor sequence"
MALPVTALLLPLALLLHAARPGSGSGAQAAEVQLQQSGPELVKPGTSVRISCKTSGYTFTEYTIHWVKQSHGKSLEWIGNINPNNGGTTYNQKFEDKATLTVDKSSSTAYMELRSLTSEDSAVYYCAAGWNFDYWGQGTTVTVSSGGGGSGGGGSGGGGSDIVMTQSHKFMSTSVGDRVSIICKASQDVGTAVDWYQQKPGQSPKLLIYWASTRHTGVPDRFTGSGSGTDFTLTITNVQSEDLADYFCQQYNSYPLTFGAGTMLDLKRAAARSDPASGAGSGSGSAPYEWSDASDPLPVSVTGNPSSSWPSPTEPSFKTGIARHLHAVIRYSVAIILFTILPFFLLHRWCSKKKDAAVMNQEPAGHRTVNREDSDEQDPQEVTYAQLDHCIFTQRKITGPSQRSKRPSTDTSVCIELPNAEPRALSPAHEHHSQALMGSSRETTALSQTQLASSHVPAAGISHG

SEQ ID NO: 2408 - protein, 464 aa, Artificial Sequence
  source: /note="Description of Artificial Sequence: Synthetic Chimeric Antigen Receptor sequence"
MALPVTALLLPLALLLHAARPGSGSGAQAAEVQLQQSGPELVKPGTSVRISCKTSGYTFTEYTIHWVKQSHGKSLEWIGNINPNNGGTTYNQKFEDKATLTVDKSSSTAYMELRSLTSEDSAVYYCAAGWNFDYWGQGTTVTVSSGGGGSGGGGSGGGGSDIVMTQSHKFMSTSVGDRVSIICKASQDVGTAVDWYQQKPGQSPKLLIYWASTRHTGVPDRFTGSGSGTDFTLTITNVQSEDLADYFCQQYNSYPLTFGAGTMLDLKRAAARSDPASGAGSGSGSAPYEWSDPSDPLLVSVTGNSSSSSSSPTEPSSKTGIRRHLHILIGTSVAIILFIILFFFLLHCCCSNKKNAAVMDQEPAGDRTVNREDSDDQDPQEVTYAQLDHCVFTQTKITSPSQRPKTPPTDTTMYMELPNAKPRSLSPAHKHHSQALRGSSRETTALSQNRVASSHVPAAGISHG

SEQ ID NO: 2409 - protein, 468 aa, Artificial Sequence
  source: /note="Description of Artificial Sequence: Synthetic Chimeric Antigen Receptor sequence"
MALPVTALLLPLALLLHAARPGSGSGAQAAEVQLQQSGPELVKPGTSVRISCKTSGYTFTEYTIHWVKQSHGKSLEWIGNINPNNGGTTYNQKFEDKATLTVDKSSSTAYMELRSLTSEDSAVYYCAAGWNFDYWGQGTTVTVSSGGGGSGGGGSGGGGSDIVMTQSHKFMSTSVGDRVSIICKASQDVGTAVDWYQQKPGQSPKLLIYWASTRHTGVPDRFTGSGSGTDFTLTITNVQSEDLADYFCQQYNSYPLTFGAGTMLDLKRAAARSDPASGAGSGSGSAGPSMGSSPPPTGPISTPAGPEDQPLTPTGSDPQSGLGRHLGVVIGILVAVVLLLLLLLLLFLILRHRRQGKHWTSTQRKADFQHPAGAVGPEPTDRGLQWRSSPAADAQEENLYAAVKDTQPEDGVEMDTRAAASEAPQDVTYAQLHSLTLRRKATEPPPSQEREPPAEPSIYATLAIHSHG

SEQ ID NO: 2410 - protein, 495 aa, Artificial Sequence
  source: /note="Description of Artificial Sequence: Synthetic Chimeric Antigen Receptor sequence"
MALPVTALLLPLALLLHAARPGSGSGAQAAEVQLQQSGPELVKPGTSVRISCKTSGYTFTEYTIHWVKQSHGKSLEWIGNINPNNGGTTYNQKFEDKATLTVDKSSSTAYMELRSLTSEDSAVYYCAAGWNFDYWGQGTTVTVSSGGGGSGGGGSGGGGSDIVMTQSHKFMSTSVGDRVSIICKASQDVGTAVDWYQQKPGQSPKLLIYWASTRHTGVPDRFTGSGSGTDFTLTITNVQSEDLADYFCQQYNSYPLTFGAGTMLDLKRAAARSDPASGAGSGSGSAKNESAASSTGKTPAAEETVTTILGMLASPYHYLIIIVVLVIILAVVVVGFSCRKKFISYLKGICSGGGGGPERVHRVLFRRRSCPSRVPGAEDNARNETLSNRYLQPTQVSEQEIQGQELAELTGVTVELPEEPQRLLEQAEAEGCQRRRLLVPVNDADSADISTLLDASATLEEGHAKETIQDQLVGSEKLFYEEDEAGSATSCLSHG

SEQ ID NO: 2411 - protein, 501 aa, Artificial Sequence
  source: /note="Description of Artificial Sequence: Synthetic Chimeric Antigen Receptor sequence"
MALPVTALLLPLALLLHAARPGSGSGAQAAEVQLQQSGPELVKPGTSVRISCKTSGYTFTEYTIHWVKQSHGKSLEWIGNINPNNGGTTYNQKFEDKATLTVDKSSSTAYMELRSLTSEDSAVYYCAAGWNFDYWGQGTTVTVSSGGGGSGGGGSGGGGSDIVMTQSHKFMSTSVGDRVSIICKASQDVGTAVDWYQQKPGQSPKLLIYWASTRHTGVPDRFTGSGSGTDFTLTITNVQSEDLADYFCQQYNSYPLTFGAGTMLDLKRAAARSDPASGAGSGSGSAGHSGGSSLPPTGPPSTPGLGRYLEVLIGVSVAFVLLLFLLLFLLLRRQRHSKHRTSDQRKTDFQRPAGAAETEPKDRGLLRRSSPAADVQEENLYAAVKDTQSEDRVELDSQSPHDEDPQAVTYAPVKHSSPRREMASPPSSLSGEFLDTKDRQVEEDRQMDTEAAASEASQDVTYAQLHSLTLRRKATEPPPSQEGEPPAEPSIYATLAIHSHG

SEQ ID NO: 2412 - protein, 510 aa, Artificial Sequence
  source: /note="Description of Artificial Sequence: Synthetic Chimeric Antigen Receptor sequence"
MALPVTALLLPLALLLHAARPGSGSGAQAAEVQLQQSGPELVKPGTSVRISCKTSGYTFTEYTIHWVKQSHGKSLEWIGNINPNNGGTTYNQKFEDKATLTVDKSSSTAYMELRSLTSEDSAVYYCAAGWNFDYWGQGTTVTVSSGGGGSGGGGSGGGGSDIVMTQSHKFMSTSVGDRVSIICKASQDVGTAVDWYQQKPGQSPKLLIYWASTRHTGVPDRFTGSGSGTDFTLTITNVQSEDLADYFCQQYNSYPLTFGAGTMLDLKRAAARSDPASGAGSGSGSAVYSLPQLLGPSCSWEAEGLHCRCSFRAWPAPSLCWRLEEKPLEGNSSQGSFKVNSSSPGPWANSSLILHGGLNSDLKVSCKAWNIYGSQSGSVLLLQGRSNLGTGVVPAALGGAGVMALLCICLCLIFFLIVKARRKQAAGRPEKMDDEDPIMGTITSGSRKKPWPDSPGDQASPPGDAPPLEEQKELHYASLSFSEMKSREPKDQEAPSTTEYSEIKTSKSHG

SEQ ID NO: 2413 - protein, 519 aa, Artificial Sequence
  source: /note="Description of Artificial Sequence: Synthetic Chimeric Antigen Receptor sequence"
MALPVTALLLPLALLLHAARPGSGSGAQAAEVQLQQSGPELVKPGTSVRISCKTSGYTFTEYTIHWVKQSHGKSLEWIGNINPNNGGTTYNQKFEDKATLTVDKSSSTAYMELRSLTSEDSAVYYCAAGWNFDYWGQGTTVTVSSGGGGSGGGGSGGGGSDIVMTQSHKFMSTSVGDRVSIICKASQDVGTAVDWYQQKPGQSPKLLIYWASTRHTGVPDRFTGSGSGTDFTLTITNVQSEDLADYFCQQYNSYPLTFGAGTMLDLKRAAARSDPASGAGSGSGSAGSLEGPRPSPTRSVSTAAGPEDQPLMPTGSVPHSGLRRHWEVLIGVLVVSILLLSLLLFLLLQHWRQGKHRTLAQRQADFQRPPGAAEPEPKDGGLQRRSSPAADVQGENFCAAVKNTQPEDGVEMDTRQSPHDEDPQAVTYAKVKHSRPRREMASPPSPLSGEFLDTKDRQAEEDRQMDTEAAASEAPQDVTYAQLHSFTLRQKATEPPPSQEGASPAEPSVYATLAIHSHG

SEQ ID NO: 2414 - protein, 528 aa, Artificial Sequence
  source: /note="Description of Artificial Sequence: Synthetic Chimeric Antigen Receptor sequence"
MALPVTALLLPLALLLHAARPGSGSGAQAAEVQLQQSGPELVKPGTSVRISCKTSGYTFTEYTIHWVKQSHGKSLEWIGNINPNNGGTTYNQKFEDKATLTVDKSSSTAYMELRSLTSEDSAVYYCAAGWNFDYWGQGTTVTVSSGGGGSGGGGSGGGGSDIVMTQSHKFMSTSVGDRVSIICKASQDVGTAVDWYQQKPGQSPKLLIYWASTRHTGVPDRFTGSGSGTDFTLTITNVQSEDLADYFCQQYNSYPLTFGAGTMLDLKRAAARSDPASGAGSGSGSAVHKESGNGHNIWVILVVTLVVPLLLVAVLIVCCCIGSGCGGDPKCMDRVCFWRLGLLRGPGAEDNAHNEILSNADSLSTFVSEQQMESQEPADLTGVTVQSPGEAQCLLGPAEAEGSQRRRLLVPANGADPTETLMLFFDKFANIVPFDSWDQLMRQLDLTKNEIDVVRAGTAGPGDALYAMLMKWVNKTGRNASIHTLLDALERMEERHAKEKIQDLLVDSGKFIYLEDGTGSAVSLESHG

SEQ ID NO: 2415 - protein, 535 aa, Artificial Sequence
  source: /note="Description of Artificial Sequence: Synthetic Chimeric Antigen Receptor sequence"
MALPVTALLLPLALLLHAARPGSGSGAQAAEVQLQQSGPELVKPGTSVRISCKTSGYTFTEYTIHWVKQSHGKSLEWIGNINPNNGGTTYNQKFEDKATLTVDKSSSTAYMELRSLTSEDSAVYYCAAGWNFDYWGQGTTVTVSSGGGGSGGGGSGGGGSDIVMTQSHKFMSTSVGDRVSIICKASQDVGTAVDWYQQKPGQSPKLLIYWASTRHTGVPDRFTGSGSGTDFTLTITNVQSEDLADYFCQQYNSYPLTFGAGTMLDLKRAAARSDPASGAGSGSGSAVHYPPQLLGPSCSWEAEGLHCSCSSQASPAPSLRWWLGEELLEGNSSQGSFEVTPSSAGPWANSSLSLHGGLSSGLRLRCKAWNVHGAQSGSVFQLLPGKLEHGGGLGLGAALGAGVAALLAFCSCLVVFRVKICRKEARKRAAAEQDVPSTLGPISQGHQHECSAGSSQDHPPPGAATYTPGKGEEQELHYASLSFQGLRLWEPADQEAPSTTEYSEIKIHTGQPLRGPGFGLQLEREMSGMVPKSHG

SEQ ID NO: 2416 - protein, 545 aa, Artificial Sequence
  source: /note="Description of Artificial Sequence: Synthetic Chimeric Antigen Receptor sequence"
MALPVTALLLPLALLLHAARPGSGSGAQAAEVQLQQSGPELVKPGTSVRISCKTSGYTFTEYTIHWVKQSHGKSLEWIGNINPNNGGTTYNQKFEDKATLTVDKSSSTAYMELRSLTSEDSAVYYCAAGWNFDYWGQGTTVTVSSGGGGSGGGGSGGGGSDIVMTQSHKFMSTSVGDRVSIICKASQDVGTAVDWYQQKPGQSPKLLIYWASTRHTGVPDRFTGSGSGTDFTLTITNVQSEDLADYFCQQYNSYPLTFGAGTMLDLKRAAARSDPASGAGSGSGSAVHYSPKLLGPSCSWEAEGLHCSCSSQASPAPSLRWWLGEELLEGNSSQDSFEVTPSSAGPWANSSLSLHGGLSSGLRLRCEAWNVHGAQSGSILQLPDKKGLISTAFSNGAFLGIGITALLFLCLALIIMKILPKRRTQTETPRPRFSRHSTILDYINVVPTAGPLAQKRNQKATPNSPRTPLPPGAPSPESKKNQKKQYQLPSFPEPKSSTQAPESQESQEELHYATLNFPGVRPRPEARMPKGTQADYAEVKFQSHG

SEQ ID NO: 2417 - protein, 551 aa, Artificial Sequence
  source: /note="Description of Artificial Sequence: Synthetic Chimeric Antigen Receptor sequence"
MALPVTALLLPLALLLHAARPGSGSGAQAAEVQLQQSGPELVKPGTSVRISCKTSGYTFTEYTIHWVKQSHGKSLEWIGNINPNNGGTTYNQKFEDKATLTVDKSSSTAYMELRSLTSEDSAVYYCAAGWNFDYWGQGTTVTVSSGGGGSGGGGSGGGGSDIVMTQSHKFMSTSVGDRVSIICKASQDVGTAVDWYQQKPGQSPKLLIYWASTRHTGVPDRFTGSGSGTDFTLTITNVQSEDLADYFCQQYNSYPLTFGAGTMLDLKRAAARSDPASGAGSGSGSAVHKESGTKHSGEAPAVEETVTSSPGTPASPCSLSGIIIGVTVAAVVLIVAVFVCKSLLWKKVLPYLKGICSGGGGDPERVDRSSQRPGAEDNVLNEIVSILQPTQVPEQEMEVQEPAEPTGVNMLSPGESEHLLEPAEAERSQRRRLLVPANEGDPTETLRQCFDDFADLVPFDSWEPLMRKLGLMDNEIKVAKAEAAGHRDTLYTMLIKWVNKTGRDASVHTLLDALETLGERLAKQKIEDHLLSSGKFMYLEGNADSAMSSHG

SEQ ID NO: 2418 - protein, 670 aa, Artificial Sequence
  source: /note="Description of Artificial Sequence: Synthetic Chimeric Antigen Receptor sequence"
MALPVTALLLPLALLLHAEVQLQQSGPELVKPGTSVRISCKTSGYTFTEYTIHWVKQSHGKSLEWIGNINPNNGGTTYNQKFEDKATLTVDKSSSTAYMELRSLTSEDSAVYYCAAGWNFDYWGQGTTVTVSSGGGGSGGGGSGGGGSDIVMTQSHKFMSTSVGDRVSIICKASQDVGTAVDWYQQKPGQSPKLLIYWASTRHTGVPDRFTGSGSGTDFTLTITNVQSEDLADYFCQQYNSYPLTFGAGTMLDLKRAAATERRAEVPTAHPSPSPRPAGQFQTLVVGVVGGLLGSLVLLVWVLAVICSRAARGTIGARRTGQPLKEDPSAVPVFSVDYGELDFQWREKTPEPPVPCVPEQTEYATIVFPSGMGTSSPARRGSADGPRSAQPLRPEDGHCSWPLSHGGSGEGRGSLLTCGDVEENPGPHMVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYKAAD

SEQ ID NO: 2419 - protein, 759 aa, Artificial Sequence
  source: /note="Description of Artificial Sequence: Synthetic Chimeric Antigen Receptor sequence"
MALPVTALLLPLALLLHAARPGSGSGAQAAEVQLQQSGPELVKPGTSVRISCKTSGYTFTEYTIHWVKQSHGKSLEWIGNINPNNGGTTYNQKFEDKATLTVDKSSSTAYMELRSLTSEDSAVYYCAAGWNFDYWGQGTTVTVSSGGGGSGGGGSGGGGSDIVMTQSHKFMSTSVGDRVSIICKASQDVGTAVDWYQQKPGQSPKLLIYWASTRHTGVPDRFTGSGSGTDFTLTITNVQSEDLADYFCQQYNSYPLTFGAGTMLDLKRAAARSDPASGAGSGSGSAKNESAASSTGKTPAAEETVTTILGMLASPYHYLIIIVVLVIILAVVVVGFSCRKKFISYLKGICSGGGGGPERVHRVLFRRRSCPSRVPGAEDNARNETLSNRYLQPTQVSEQEIQGQELAELTGVTVELPEEPQRLLEQAEAEGCQRRRLLVPVNDADSADISTLLDASATLEEGHAKETIQDQLVGSEKLFYEEDEAGSATSCLSHGGSGEGRGSLLTCGDVEENPGPHMVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYKAAD

SEQ ID NO: 2420 - protein, 792 aa, Artificial Sequence
  source: /note="Description of Artificial Sequence: Synthetic Chimeric Antigen Receptor sequence"
MALPVTALLLPLALLLHAARPGSGSGAQAAEVQLQQSGPELVKPGTSVRISCKTSGYTFTEYTIHWVKQSHGKSLEWIGNINPNNGGTTYNQKFEDKATLTVDKSSSTAYMELRSLTSEDSAVYYCAAGWNFDYWGQGTTVTVSSGGGGSGGGGSGGGGSDIVMTQSHKFMSTSVGDRVSIICKASQDVGTAVDWYQQKPGQSPKLLIYWASTRHTGVPDRFTGSGSGTDFTLTITNVQSEDLADYFCQQYNSYPLTFGAGTMLDLKRAAARSDPASGAGSGSGSAVHKESGNGHNIWVILVVTLVVPLLLVAVLIVCCCIGSGCGGDPKCMDRVCFWRLGLLRGPGAEDNAHNEILSNADSLSTFVSEQQMESQEPADLTGVTVQSPGEAQCLLGPAEAEGSQRRRLLVPANGADPTETLMLFFDKFANIVPFDSWDQLMRQLDLTKNEIDVVRAGTAGPGDALYAMLMKWVNKTGRNASIHTLLDALERMEERHAKEKIQDLLVDSGKFIYLEDGTGSAVSLESHGGSGEGRGSLLTCGDVEENPGPHMVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYKAAD

SEQ ID NO: 2421 - protein, 815 aa, Artificial Sequence
  source: /note="Description of Artificial Sequence: Synthetic Chimeric Antigen Receptor sequence"
MALPVTALLLPLALLLHAARPGSGSGAQAAEVQLQQSGPELVKPGTSVRISCKTSGYTFTEYTIHWVKQSHGKSLEWIGNINPNNGGTTYNQKFEDKATLTVDKSSSTAYMELRSLTSEDSAVYYCAAGWNFDYWGQGTTVTVSSGGGGSGGGGSGGGGSDIVMTQSHKFMSTSVGDRVSIICKASQDVGTAVDWYQQKPGQSPKLLIYWASTRHTGVPDRFTGSGSGTDFTLTITNVQSEDLADYFCQQYNSYPLTFGAGTMLDLKRAAARSDPASGAGSGSGSAVHKESGTKHSGEAPAVEETVTSSPGTPASPCSLSGIIIGVTVAAVVLIVAVFVCKSLLWKKVLPYLKGICSGGGGDPERVDRSSQRPGAEDNVLNEIVSILQPTQVPEQEMEVQEPAEPTGVNMLSPGESEHLLEPAEAERSQRRRLLVPANEGDPTETLRQCFDDFADLVPFDSWEPLMRKLGLMDNEIKVAKAEAAGHRDTLYTMLIKWVNKTGRDASVHTLLDALETLGERLAKQKIEDHLLSSGKFMYLEGNADSAMSSHGGSGEGRGSLLTCGDVEENPGPHMVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYKAAD

SEQ ID NO: 2422 - protein, 346 aa, Artificial Sequence
  source: /note="Description of Artificial Sequence: Synthetic Chimeric Antigen Receptor sequence"
MDKDCEMKRTTLDSPLGKLELSGCEQGLHRIIFLGKGTSAADAVEVPAPAAVLGGPEPLMQATAWLNAYFHQPEAIEEFPVPALHHPVFQQESFTRQVLWKLLKVVKFGEVISYSHLAALAGNPAATAAVKTALSGNPVPILIPCHRVVQGDLDVGGYEGGLAVKEWLLAHEGHRLGKPGLGGGGGSGGGGSKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2423 - protein, 430 aa, Artificial Sequence
  source: /note="Description of Artificial Sequence: Synthetic Chimeric Antigen Receptor sequence"
EVKLQQSGPELVKPGASVKISCKTSGYTFTEYTMHWVKQSHGKSLEWIGGINPNNGGTSYNQKFKGKATLTVDKSSSTAYMELRSLTSEDSAVYYCALQGFAYWGQGTPLTVSSGGGGSGGGGSGGGGSMEIEITQTPALMSASPGEKVTMTCSASSSVSYMYWYQQKPRSSPKPWIYLTSNLASGVPARFSGSGSGTSYSLTISSMEAEDAATYYCQQWSSNPYTFGGGTRLELKGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2424 - protein, 432 aa, Artificial Sequence
  source: /note="Description of Artificial Sequence: Synthetic Chimeric Antigen Receptor sequence"
QVQLKESGPGLVAPSQTLSITCTVSGFSLTSYGVHWVRQPPGKGLEWLGVIWAGGFTNYNSALKSRLSISKDNSKSQVLLKMTSLQTDDTAMYYCARRGSSYSMDYWGQGTSVTVSSGGGGSGGGGSGGGGSEIVLSQSPAITAASLGQKVTITCSASSNVSYIHWYQQRSGTSPRPWIYEISKLASGVPVRFSGSGSGTSYSLTISSMEAEDAAIYYCQQWNYPLITFGSGTKLEIQGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2425 - protein, 433 aa, Artificial Sequence
  source: /note="Description of Artificial Sequence: Synthetic Chimeric Antigen Receptor sequence"
EVKLQQSGPELVKPGASVKISCKTSGYTFTEYTMHWVKQSHGKSLEWIGGINPNNGGTSYNQKFKGKATLTVDKSSSTAYMELRSLTSEDSAVYYCALQGFAYWGQGTPLTVSSGGGGSGGGGSGGGGSMEIEITQTPALMSASPGEKVTMTCSASSSVSYMYWYQQKPRSSPKPWIYLTSNLASGVPARFSGSGSGTSYSLTISSMEAEDAATYYCQQWSSNPYTFGGGTRLELKGLAVSTISSFFPPGYQIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2426 - protein, 434 aa, Artificial Sequence
  source: /note="Description of Artificial Sequence: Synthetic Chimeric Antigen Receptor sequence"
EVKLVESGGGLVKPGGSLKLSCAASGFTFSSYAMSWVRQTPEKRLEWVASISTGASAYFPDSVKGRFTISRDNARNILYLQMSSLRSEDTAMYYCARITTSTWYFDVWGAGTTVTVSSGGGGSGGGGSGGGGSDIKMTQSPSSMYASLGERVTITCKASQDINSYLSWFQQKPGKSPKTLIYRANRLVDGVPSRFSGSGSGQDYSLTISSLEYEDMGIYYCLQYDEFPYTFGGGTKLEIKGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2427 - protein, 435 aa, Artificial Sequence
  source: /note="Description of Artificial Sequence: Synthetic Chimeric Antigen Receptor sequence"
EVKLVESGGGLVKPGGSLKLSCAASGFTFSSYAMSWVRQIPEKRLEWVASISRGGTTYYPDSVKGRFTISRDNVRNILYLQMSSLRSEDTAMYYCGRYDYDGYYAMDYWGQGTSVTVSSGGGGSGGGGSGGGGSDIKMTQSPSSMYASLGERVTITCKASPDINSYLSWFQQKPGKSPKTLIYRANRLVDGVPSRFSGGGSGQDYSLTINSLEYEDMGIYYCLQYDEFPYTFGGGTKLEMKGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2428 - protein, 435 aa, Artificial Sequence
  source: /note="Description of Artificial Sequence: Synthetic Chimeric Antigen Receptor sequence"
EVQLQQSGPELEKPGASVKISCKASGFAFTGYNMNWVKQTNGKSLEWIGSIDPYYGGSTYNQKFKDKATLTVDKSSSTAYMQLKSLTSDDSAVYYCARSPGGDYAMDYWGQGTSVTVSSGGGGSGGGGSGGGGSDIKMTQSPSSMYASVGERVTITCKASQGINSYSGWFQQKPGKSPKTLIYRGNRLVDGVPSRFSGSGSGQDYSLTISSLEYEDMGIYYCLQYDEFPYTFGGGTKLEIKGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2429 - protein, 435 aa, Artificial Sequence
  source: /note="Description of Artificial Sequence: Synthetic Chimeric Antigen Receptor sequence"
QVQLKESGPGLVAPSQTLSITCTVSGFSLTSYGVHWVRQPPGKGLEWLGVIWAGGFTNYNSALKSRLSISKDNSKSQVLLKMTSLQTDDTAMYYCARRGSSYSMDYWGQGTSVTVSSGGGGSGGGGSGGGGSEIVLSQSPAITAASLGQKVTITCSASSNVSYIHWYQQRSGTSPRPWIYEISKLASGVPVRFSGSGSGTSYSLTISSMEAEDAAIYYCQQWNYPLITFGSGTKLEIQGLAVSTISSFFPPGYQIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2430 - protein, 435 aa, Artificial Sequence
  source: /note="Description of Artificial Sequence: Synthetic Chimeric Antigen Receptor sequence"
QVQLQQPGAELVKPGTSVKLSCKASGYNFTNYWINWVKLRPGQGLEWIGEIYPGSGSTNYNEKFKSKATLTADTSSSTAYMQLSSLASEDSALYYCARDGNYYAMDYWGQGTSVTVSSGGGGSGGGGSGGGGSDIQMTQTTSSLSASLGDRVTITCRASQDINNYLNWYQQKPDGTVKLLIYYTSALHSGVPSRFSGSGSGTDYSLTISNLEQEDIATYFCQQGNTLPPYTFGGGTKLEIKGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2431 - protein, 436 aa, Artificial Sequence
  source: /note="Description of Artificial Sequence: Synthetic Chimeric Antigen Receptor sequence"
EVKLQESGAELARPGASVKMSCKASGYTFTSYTMHWVKQRPGQGLEWIGYINPSSGYTEYNQKFKDKTTLTADKSSSTAYMQLSSLTSGDSAVYYCARRVLWLRRGDYWGQGTILTVSAGGGGSGGGGSGGGGSMEVLITQTPSSLSASLGERVSLTCRASQDIGSSLNWLQQEPDGTIKRLIYATSSLDSGVPKRFSGSRSGSDYSLTISSLESEDFVDYYCLQYASSPYTFGGGTKLELKGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2432 - protein, 437 aa, Artificial Sequence
  source: /note="Description of Artificial Sequence: Synthetic Chimeric Antigen Receptor sequence"
EVKLVESGGGLVKPGGSLKLSCAASGFTFSSYAMSWVRQTPEKRLEWVASISTGASAYFPDSVKGRFTISRDNARNILYLQMSSLRSEDTAMYYCARITTSTWYFDVWGAGTTVTVSSGGGGSGGGGSGGGGSDIKMTQSPSSMYASLGERVTITCKASQDINSYLSWFQQKPGKSPKTLIYRANRLVDGVPSRFSGSGSGQDYSLTISSLEYEDMGIYYCLQYDEFPYTFGGGTKLEIKGLAVSTISSFFPPGYQIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2433 - protein, 437 aa, Artificial Sequence
  source: /note="Description of Artificial Sequence: Synthetic Chimeric Antigen Receptor sequence"
QVQLQQSGAELVRPGASVTLSCKASGYTFSDYEMHWVIQTPVHGLEWIGAIDPETGGTAYNQKFKGKAILTADKSSSTAYMELRSLTSEDSAVYYCTGYYDYDSFTYWGQGTLVTVSAGGGGSGGGGSGGGGSDIVMTQSQKIMSTTVGDRVSITCKASQNVDAAVAWYQQKPGQSPKLLIYSASNRYTGVPDRFTGSGSGTDFTLTISNMQSEDLADYFCQQYDIYPYTFGGGTKLEIKGLAVSTISSFFPPGYQIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2434 - protein, 438 aa, Artificial Sequence
  source: /note="Description of Artificial Sequence: Synthetic Chimeric Antigen Receptor sequence"
EVKLVESGGGLVKPGGSLKLSCAASGFTFSSYAMSWVRQIPEKRLEWVASISRGGTTYYPDSVKGRFTISRDNVRNILYLQMSSLRSEDTAMYYCGRYDYDGYYAMDYWGQGTSVTVSSGGGGSGGGGSGGGGSDIKMTQSPSSMYASLGERVTITCKASPDINSYLSWFQQKPGKSPKTLIYRANRLVDGVPSRFSGGGSGQDYSLTINSLEYEDMGIYYCLQYDEFPYTFGGGTKLEMKGLAVSTISSFFPPGYQIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2435 - protein, 438 aa, Artificial Sequence
  source: /note="Description of Artificial Sequence: Synthetic Chimeric Antigen Receptor sequence"
EVQLQQSGPELEKPGASVKISCKASGFAFTGYNMNWVKQTNGKSLEWIGSIDPYYGGSTYNQKFKDKATLTVDKSSSTAYMQLKSLTSDDSAVYYCARSPGGDYAMDYWGQGTSVTVSSGGGGSGGGGSGGGGSDIKMTQSPSSMYASVGERVTITCKASQGINSYSGWFQQKPGKSPKTLIYRGNRLVDGVPSRFSGSGSGQDYSLTISSLEYEDMGIYYCLQYDEFPYTFGGGTKLEIKGLAVSTISSFFPPGYQIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2436 - protein, 438 aa, Artificial Sequence
  source: /note="Description of Artificial Sequence: Synthetic Chimeric Antigen Receptor sequence"
QVQLQQPGAELVKPGTSVKLSCKASGYNFTNYWINWVKLRPGQGLEWIGEIYPGSGSTNYNEKFKSKATLTADTSSSTAYMQLSSLASEDSALYYCARDGNYYAMDYWGQGTSVTVSSGGGGSGGGGSGGGGSDIQMTQTTSSLSASLGDRVTITCRASQDINNYLNWYQQKPDGTVKLLIYYTSALHSGVPSRFSGSGSGTDYSLTISNLEQEDIATYFCQQGNTLPPYTFGGGTKLEIKGLAVSTISSFFPPGYQIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2437 - protein, 439 aa, Artificial Sequence
  source: /note="Description of Artificial Sequence: Synthetic Chimeric Antigen Receptor sequence"
EVKLQESGAELARPGASVKMSCKASGYTFTSYTMHWVKQRPGQGLEWIGYINPSSGYTEYNQKFKDKTTLTADKSSSTAYMQLSSLTSGDSAVYYCARRVLWLRRGDYWGQGTILTVSAGGGGSGGGGSGGGGSMEVLITQTPSSLSASLGERVSLTCRASQDIGSSLNWLQQEPDGTIKRLIYATSSLDSGVPKRFSGSRSGSDYSLTISSLESEDFVDYYCLQYASSPYTFGGGTKLELKGLAVSTISSFFPPGYQIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2438 - protein, 454 aa, Artificial Sequence
  source: /note="Description of Artificial Sequence: Synthetic Chimeric Antigen Receptor sequence"
MALPVTALLLPLALLLHAARPQVQLQESGPGLVKPSETLSLTCTVSGFSLTSYGYVHWVRQPPGKGLEWLGVIWAGGFTNYNPSLKSRLTISKDNSKNQVSLKLSSVTAADTAVYYCARRGSSYSMDYWGQGTLVTVSSGGGGSGGGGSGGGGSEIVLTQSPATLSLSPGERATLSCRASSNVSYIHWYQQKPGQAPRPWIYEISKLATGIPARFSGSGSGTDYTLTISSLEPEDFAVYYCQQWNYPLITFGQGTKLEIKGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2439 - protein, 455 aa, Artificial Sequence
  source: /note="Description of Artificial Sequence: Synthetic Chimeric Antigen Receptor sequence"
MALPVTALLLPLALLLHAARPEVQLVESGGGLVKPGGSLRLSCAASGFTFSSYAMSWVRQAPGKGLEWVASISTGASAYFADSVKGRFTISRDNAKNSLYLQMNSLRAEDTAVYYCARITTSTWYFDVWGQGTTVTVSSGGGGSGGGGSGGGGSDIQMTQSPSSLSASVGDRVTITCRASQDINSYLSWFQQKPGKAPKTLIYRANRLQSGVPSRFSGSGSGQDYTLTISSLQPEDFATYYCLQYDEFPYTFGQGTKLEIKGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2440 - protein, 457 aa, Artificial Sequence
  source: /note="Description of Artificial Sequence: Synthetic Chimeric Antigen Receptor sequence"
MALPVTALLLPLALLLHAARPQVQLQESGPGLVKPSETLSLTCTVSGFSLTSYGYVHWVRQPPGKGLEWLGVIWAGGFTNYNPSLKSRLTISKDNSKNQVSLKLSSVTAADTAVYYCARRGSSYSMDYWGQGTLVTVSSGGGGSGGGGSGGGGSEIVLTQSPATLSLSPGERATLSCRASSNVSYIHWYQQKPGQAPRPWIYEISKLATGIPARFSGSGSGTDYTLTISSLEPEDFAVYYCQQWNYPLITFGQGTKLEIKGLAVSTISSFFPPGYQIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2441 - protein, 458 aa, Artificial Sequence
  source: /note="Description of Artificial Sequence: Synthetic Chimeric Antigen Receptor sequence"
MALPVTALLLPLALLLHAARPEVQLVESGGGLVKPGGSLRLSCAASGFTFSSYAMSWVRQAPGKGLEWVASISTGASAYFADSVKGRFTISRDNAKNSLYLQMNSLRAEDTAVYYCARITTSTWYFDVWGQGTTVTVSSGGGGSGGGGSGGGGSDIQMTQSPSSLSASVGDRVTITCRASQDINSYLSWFQQKPGKAPKTLIYRANRLQSGVPSRFSGSGSGQDYTLTISSLQPEDFATYYCLQYDEFPYTFGQGTKLEIKGLAVSTISSFFPPGYQIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2442 - protein, 459 aa, Artificial Sequence
  source: /note="Description of Artificial Sequence: Synthetic Chimeric Antigen Receptor sequence"
EVKLQQSGPELVKPGASVKISCKTSGYTFTEYTMHWVKQSHGKSLEWIGGINPNNGGTSYNQKFKGKATLTVDKSSSTAYMELRSLTSEDSAVYYCALQGFAYWGQGTPLTVSSGGGGSGGGGSGGGGSMEIEITQTPALMSASPGEKVTMTCSASSSVSYMYWYQQKPRSSPKPWIYLTSNLASGVPARFSGSGSGTSYSLTISSMEAEDAATYYCQQWSSNPYTFGGGTRLELKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2443 - protein, 461 aa, Artificial Sequence
  source: /note="Description of Artificial Sequence: Synthetic Chimeric Antigen Receptor sequence"
QVQLKESGPGLVAPSQTLSITCTVSGFSLTSYGVHWVRQPPGKGLEWLGVIWAGGFTNYNSALKSRLSISKDNSKSQVLLKMTSLQTDDTAMYYCARRGSSYSMDYWGQGTSVTVSSGGGGSGGGGSGGGGSEIVLSQSPAITAASLGQKVTITCSASSNVSYIHWYQQRSGTSPRPWIYEISKLASGVPVRFSGSGSGTSYSLTISSMEAEDAAIYYCQQWNYPLITFGSGTKLEIQTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2444 - protein, 462 aa, Artificial Sequence
  source: /note="Description of Artificial Sequence: Synthetic Chimeric Antigen Receptor sequence"
EVKLQQSGPELVKPGASVKISCKTSGYTFTEYTMHWVKQSHGKSLEWIGGINPNNGGTSYNQKFKGKATLTVDKSSSTAYMELRSLTSEDSAVYYCALQGFAYWGQGTPLTVSSGGGGSGGGGSGGGGSMEIEITQTPALMSASPGEKVTMTCSASSSVSYMYWYQQKPRSSPKPWIYLTSNLASGVPARFSGSGSGTSYSLTISSMEAEDAATYYCQQWSSNPYTFGGGTRLELKTTTPAPRPPTPAPTIASQPLSLRPEACRPAAGGAVHTRGLDFACDIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2445 - protein, 463 aa, Artificial Sequence
  source: /note="Description of Artificial Sequence: Synthetic Chimeric Antigen Receptor sequence"
EVKLVESGGGLVKPGGSLKLSCAASGFTFSSYAMSWVRQTPEKRLEWVASISTGASAYFPDSVKGRFTISRDNARNILYLQMSSLRSEDTAMYYCARITTSTWYFDVWGAGTTVTVSSGGGGSGGGGSGGGGSDIKMTQSPSSMYASLGERVTITCKASQDINSYLSWFQQKPGKSPKTLIYRANRLVDGVPSRFSGSGSGQDYSLTISSLEYEDMGIYYCLQYDEFPYTFGGGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2446 - protein, 463 aa, Artificial Sequence
  source: /note="Description of Artificial Sequence: Synthetic Chimeric Antigen Receptor sequence"
QVQLQQSGAELVRPGASVTLSCKASGYTFSDYEMHWVIQTPVHGLEWIGAIDPETGGTAYNQKFKGKAILTADKSSSTAYMELRSLTSEDSAVYYCTGYYDYDSFTYWGQGTLVTVSAGGGGSGGGGSGGGGSDIVMTQSQKIMSTTVGDRVSITCKASQNVDAAVAWYQQKPGQSPKLLIYSASNRYTGVPDRFTGSGSGTDFTLTISNMQSEDLADYFCQQYDIYPYTFGGGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2447 - protein, 464 aa, Artificial Sequence
  source: /note="Description of Artificial Sequence: Synthetic Chimeric Antigen Receptor sequence"
EVKLVESGGGLVKPGGSLKLSCAASGFTFSSYAMSWVRQIPEKRLEWVASISRGGTTYYPDSVKGRFTISRDNVRNILYLQMSSLRSEDTAMYYCGRYDYDGYYAMDYWGQGTSVTVSSGGGGSGGGGSGGGGSDIKMTQSPSSMYASLGERVTITCKASPDINSYLSWFQQKPGKSPKTLIYRANRLVDGVPSRFSGGGSGQDYSLTINSLEYEDMGIYYCLQYDEFPYTFGGGTKLEMKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2448 - protein, 464 aa, Artificial Sequence
  source: /note="Description of Artificial Sequence: Synthetic Chimeric Antigen Receptor sequence"
EVQLQQSGPELEKPGASVKISCKASGFAFTGYNMNWVKQTNGKSLEWIGSIDPYYGGSTYNQKFKDKATLTVDKSSSTAYMQLKSLTSDDSAVYYCARSPGGDYAMDYWGQGTSVTVSSGGGGSGGGGSGGGGSDIKMTQSPSSMYASVGERVTITCKASQGINSYSGWFQQKPGKSPKTLIYRGNRLVDGVPSRFSGSGSGQDYSLTISSLEYEDMGIYYCLQYDEFPYTFGGGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2449 - protein, 464 aa, Artificial Sequence
  source: /note="Description of Artificial Sequence: Synthetic Chimeric Antigen Receptor sequence"
QVQLKESGPGLVAPSQTLSITCTVSGFSLTSYGVHWVRQPPGKGLEWLGVIWAGGFTNYNSALKSRLSISKDNSKSQVLLKMTSLQTDDTAMYYCARRGSSYSMDYWGQGTSVTVSSGGGGSGGGGSGGGGSEIVLSQSPAITAASLGQKVTITCSASSNVSYIHWYQQRSGTSPRPWIYEISKLASGVPVRFSGSGSGTSYSLTISSMEAEDAAIYYCQQWNYPLITFGSGTKLEIQTTTPAPRPPTPAPTIASQPLSLRPEACRPAAGGAVHTRGLDFACDIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2450 - protein, 464 aa, Artificial Sequence
  source: /note="Description of Artificial Sequence: Synthetic Chimeric Antigen Receptor sequence"
QVQLQQPGAELVKPGTSVKLSCKASGYNFTNYWINWVKLRPGQGLEWIGEIYPGSGSTNYNEKFKSKATLTADTSSSTAYMQLSSLASEDSALYYCARDGNYYAMDYWGQGTSVTVSSGGGGSGGGGSGGGGSDIQMTQTTSSLSASLGDRVTITCRASQDINNYLNWYQQKPDGTVKLLIYYTSALHSGVPSRFSGSGSGTDYSLTISNLEQEDIATYFCQQGNTLPPYTFGGGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2451 - protein, 466 aa, Artificial Sequence
  source: /note="Description of Artificial Sequence: Synthetic Chimeric Antigen Receptor sequence"
EVKLVESGGGLVKPGGSLKLSCAASGFTFSSYAMSWVRQTPEKRLEWVASISTGASAYFPDSVKGRFTISRDNARNILYLQMSSLRSEDTAMYYCARITTSTWYFDVWGAGTTVTVSSGGGGSGGGGSGGGGSDIKMTQSPSSMYASLGERVTITCKASQDINSYLSWFQQKPGKSPKTLIYRANRLVDGVPSRFSGSGSGQDYSLTISSLEYEDMGIYYCLQYDEFPYTFGGGTKLEIKTTTPAPRPPTPAPTIASQPLSLRPEACRPAAGGAVHTRGLDFACDIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2452 - protein, 466 aa, Artificial Sequence
  source: /note="Description of Artificial Sequence: Synthetic Chimeric Antigen Receptor sequence"
QVQLQQSGAELVRPGASVTLSCKASGYTFSDYEMHWVIQTPVHGLEWIGAIDPETGGTAYNQKFKGKAILTADKSSSTAYMELRSLTSEDSAVYYCTGYYDYDSFTYWGQGTLVTVSAGGGGSGGGGSGGGGSDIVMTQSQKIMSTTVGDRVSITCKASQNVDAAVAWYQQKPGQSPKLLIYSASNRYTGVPDRFTGSGSGTDFTLTISNMQSEDLADYFCQQYDIYPYTFGGGTKLEIKTTTPAPRPPTPAPTIASQPLSLRPEACRPAAGGAVHTRGLDFACDIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2453 - protein, 467 aa, Artificial Sequence
  source: /note="Description of Artificial Sequence: Synthetic Chimeric Antigen Receptor sequence"
EVKLVESGGGLVKPGGSLKLSCAASGFTFSSYAMSWVRQIPEKRLEWVASISRGGTTYYPDSVKGRFTISRDNVRNILYLQMSSLRSEDTAMYYCGRYDYDGYYAMDYWGQGTSVTVSSGGGGSGGGGSGGGGSDIKMTQSPSSMYASLGERVTITCKASPDINSYLSWFQQKPGKSPKTLIYRANRLVDGVPSRFSGGGSGQDYSLTINSLEYEDMGIYYCLQYDEFPYTFGGGTKLEMKTTTPAPRPPTPAPTIASQPLSLRPEACRPAAGGAVHTRGLDFACDIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2454 - protein, 467 aa, Artificial Sequence
  source: /note="Description of Artificial Sequence: Synthetic Chimeric Antigen Receptor sequence"
EVQLQQSGPELEKPGASVKISCKASGFAFTGYNMNWVKQTNGKSLEWIGSIDPYYGGSTYNQKFKDKATLTVDKSSSTAYMQLKSLTSDDSAVYYCARSPGGDYAMDYWGQGTSVTVSSGGGGSGGGGSGGGGSDIKMTQSPSSMYASVGERVTITCKASQGINSYSGWFQQKPGKSPKTLIYRGNRLVDGVPSRFSGSGSGQDYSLTISSLEYEDMGIYYCLQYDEFPYTFGGGTKLEIKTTTPAPRPPTPAPTIASQPLSLRPEACRPAAGGAVHTRGLDFACDIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2455 - protein, 467 aa, Artificial Sequence
  source: /note="Description of Artificial Sequence: Synthetic Chimeric Antigen Receptor sequence"
QVQLQQPGAELVKPGTSVKLSCKASGYNFTNYWINWVKLRPGQGLEWIGEIYPGSGSTNYNEKFKSKATLTADTSSSTAYMQLSSLASEDSALYYCARDGNYYAMDYWGQGTSVTVSSGGGGSGGGGSGGGGSDIQMTQTTSSLSASLGDRVTITCRASQDINNYLNWYQQKPDGTVKLLIYYTSALHSGVPSRFSGSGSGTDYSLTISNLEQEDIATYFCQQGNTLPPYTFGGGTKLEIKTTTPAPRPPTPAPTIASQPLSLRPEACRPAAGGAVHTRGLDFACDIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2456 - protein, 468 aa, Artificial Sequence
  source: /note="Description of Artificial Sequence: Synthetic Chimeric Antigen Receptor sequence"
EVKLQESGAELARPGASVKMSCKASGYTFTSYTMHWVKQRPGQGLEWIGYINPSSGYTEYNQKFKDKTTLTADKSSSTAYMQLSSLTSGDSAVYYCARRVLWLRRGDYWGQGTILTVSAGGGGSGGGGSGGGGSMEVLITQTPSSLSASLGERVSLTCRASQDIGSSLNWLQQEPDGTIKRLIYATSSLDSGVPKRFSGSRSGSDYSLTISSLESEDFVDYYCLQYASSPYTFGGGTKLELKTTTPAPRPPTPAPTIASQPLSLRPEACRPAAGGAVHTRGLDFACDIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2457 - protein, 483 aa, Artificial Sequence
  source: /note="Description of Artificial Sequence: Synthetic Chimeric Antigen Receptor sequence"
MALPVTALLLPLALLLHAARPEIVLTQSPGTLSLSPGERATLSCRASQSVSSSYLAWYQQKPGQAPRLLIYGASSRATGIPDRFSGSGSGTDFTLTISRLEPEDFAVYYCQQYGSSFGPGTKVDIKRGGGGSGGGGSGGGGSQVQLVQSGTEVKKPGSSVKVSCQASGGSLSSHGVSWLRQAPGQGLEWVGRIIPMFGVTDYAQKFQDRVTITADKSTSTVYMELISLGSDDTAVYFCARESRGATFEYWGQGTLVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2458 - protein, 483 aa, Artificial Sequence
  source: /note="Description of Artificial Sequence: Synthetic Chimeric Antigen Receptor sequence"
MALPVTALLLPLALLLHAARPQVQLQESGPGLVKPSETLSLTCTVSGFSLTSYGYVHWVRQPPGKGLEWLGVIWAGGFTNYNPSLKSRLTISKDNSKNQVSLKLSSVTAADTAVYYCARRGSSYSMDYWGQGTLVTVSSGGGGSGGGGSGGGGSEIVLTQSPATLSLSPGERATLSCRASSNVSYIHWYQQKPGQAPRPWIYEISKLATGIPARFSGSGSGTDYTLTISSLEPEDFAVYYCQQWNYPLITFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2459 - protein, 484 aa, Artificial Sequence
  source: /note="Description of Artificial Sequence: Synthetic Chimeric Antigen Receptor sequence"
MALPVTALLLPLALLLHAARPEVQLVESGGGLVKPGGSLRLSCAASGFTFSSYAMSWVRQAPGKGLEWVASISTGASAYFADSVKGRFTISRDNAKNSLYLQMNSLRAEDTAVYYCARITTSTWYFDVWGQGTTVTVSSGGGGSGGGGSGGGGSDIQMTQSPSSLSASVGDRVTITCRASQDINSYLSWFQQKPGKAPKTLIYRANRLQSGVPSRFSGSGSGQDYTLTISSLQPEDFATYYCLQYDEFPYTFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2460 - protein, 485 aa, Artificial Sequence
  source: /note="Description of Artificial Sequence: Synthetic Chimeric Antigen Receptor sequence"
MALPVTALLLPLALLLHAARPDIQMTQSPSSVSASVGDRVTITCRASQGISTLLAWYQQKPGKAPKLLISSASSLQSGVPARFSGSGSGTDFTLTISSLQPEDFATYYCQQSYRAPTFGQGTKVEIKRGGGGSGGGGSGGGGSQVTLKESGPTLLKPTQTLTLTCTFSGFSLSTRGVGVGWIRQPPGQALEWLTLIYWDDDKRYSPSLKSRLTITKDTSKNQVVLTMTNMESVDTATYYCAQQTMTGAFDIWGQGTTVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2461 - protein, 486 aa, Artificial Sequence
  source: /note="Description of Artificial Sequence: Synthetic Chimeric Antigen Receptor sequence"
MALPVTALLLPLALLLHAARPEVKLQESGAELARPGASVKMSCKASGYTFTSYTMHWVKQRPGQGLEWIGYINPSSGYTEYNQKFKDKTTLTADKSSSTAYMQLSSLTSGDSAVYYCARRVLWLRRGDYWGQGTILTVSAGGGGSGGGGSGGGGSMEVLITQTPSSLSASLGERVSLTCRASQDIGSSLNWLQQEPDGTIKRLIYATSSLDSGVPKRFSGSRSGSDYSLTISSLESEDFVDYYCLQYASSPYTFGGGTKLELKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2462 - protein, 486 aa, Artificial Sequence
  source: /note="Description of Artificial Sequence: Synthetic Chimeric Antigen Receptor sequence"
MALPVTALLLPLALLLHAARPQVQLQESGPGLVKPSETLSLTCTVSGFSLTSYGYVHWVRQPPGKGLEWLGVIWAGGFTNYNPSLKSRLTISKDNSKNQVSLKLSSVTAADTAVYYCARRGSSYSMDYWGQGTLVTVSSGGGGSGGGGSGGGGSEIVLTQSPATLSLSPGERATLSCRASSNVSYIHWYQQKPGQAPRPWIYEISKLATGIPARFSGSGSGTDYTLTISSLEPEDFAVYYCQQWNYPLITFGQGTKLEIKTTTPAPRPPTPAPTIASQPLSLRPEACRPAAGGAVHTRGLDFACDIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2463 - protein, 487 aa, Artificial Sequence
  source: /note="Description of Artificial Sequence: Synthetic Chimeric Antigen Receptor sequence"
MALPVTALLLPLALLLHAARPEVQLVESGGGLVKPGGSLRLSCAASGFTFSSYAMSWVRQAPGKGLEWVASISTGASAYFADSVKGRFTISRDNAKNSLYLQMNSLRAEDTAVYYCARITTSTWYFDVWGQGTTVTVSSGGGGSGGGGSGGGGSDIQMTQSPSSLSASVGDRVTITCRASQDINSYLSWFQQKPGKAPKTLIYRANRLQSGVPSRFSGSGSGQDYTLTISSLQPEDFATYYCLQYDEFPYTFGQGTKLEIKTTTPAPRPPTPAPTIASQPLSLRPEACRPAAGGAVHTRGLDFACDIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2464 - protein, 488 aa, Artificial Sequence
  source: /note="Description of Artificial Sequence: Synthetic Chimeric Antigen Receptor sequence"
MALPVTALLLPLALLLHAARPETTLTQSPAFMSATPGDKVNISCKASQDIDDDLNWYQQKPGEAPILIIQEATTLVPGIPPRFSGSGFGTDFTLTINSMQSEDVAYYFCLQHDNFPPTFGQGTKVEIKRGGGGSGGGGSGGGGSQVQLQESGPGLVKSSETLSLTCTVSGGSMNNYYWSWIRQPAGKGLEWMGRIYSSGSTNYNPALKSRVTMSVDTSKNQFSLNLSSVTAADTAIYYCARASWSGTYWALFDYWGQGTLVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2465 - protein, 489 aa, Artificial Sequence
  source: /note="Description of Artificial Sequence: Synthetic Chimeric Antigen Receptor sequence"
MALPVTALLLPLALLLHAARPDIQMTQSPSSLSASVGDRVTITCQASQDISNYLNWYQQKPGKAPKLLIYDASNLETGVPSRFSGSGSGTDFTFTISSLQPEDIATYYCQQYDNLPLTFGGGTKLEIKRGGGGSGGGGSGGGGSEVQLVESGGGLVKPGGSLRLSCAASGFTFSDYYMGWVRQAPGKGLKWLSYISDRAHTIYDTDSVKGRFTISRDDAKSSLYLRMNNLRVEDTAVYYCARAVGAGEGFDYWGQGTLVTVSSAAATTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2466 - protein, 490 aa, Artificial Sequence
  source: /note="Description of Artificial Sequence: Synthetic Chimeric Antigen Receptor sequence"
MALPVTALLLPLALLLHAARPQSALTQPASVSGSPGQSITISCTGTSSDVGGYNYVSWYQQHPGKAPKLMIYDVSKRPSGVSNRFSGSKSGNTASLTISGLQAEDEADYYCSSYTGRSTVFGGGTKLTVLGGGGGSGGGGSGGGGSEVQLVQSGGDLVQPGGSLRLSCAASGFTFSSYSMNWVRQAPGKGLEWVSSISSSSSYIYYADSVKGRFTISRDNAKNSLYLQMNSLRAEDTAVYYCARGLGGWTHDAFDIWGQGTTVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2467 - protein, 491 aa, Artificial Sequence
  source: /note="Description of Artificial Sequence: Synthetic Chimeric Antigen Receptor sequence"
MALPVTALLLPLALLLHAARPQSALTQPPSASGTPGQRVTISCPGSSSNIGSNYVYWYQQLPGTAPKLLIYRNNQRPSGVPDRFSGSKSGTSATLGITGLQTGDEADYYCGTWDSSLSAYVFGTGTKVTVLGGGGGSGGGGSGGGGSQVQLQQSGAEVKKPGASVKVSCKASGYTFSRYYIHWVRRAPGQGLEWMGLINPGGGSTNYAQKFQGRVTMTRDTSTNTVYLELSSLRSDDTAVYYCARDYGTIDARRFDFWGQGTLVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2468 - protein, 491 aa, Artificial Sequence
  source: /note="Description of Artificial Sequence: Synthetic Chimeric Antigen Receptor sequence"
MALPVTALLLPLALLLHAARPQSVLTQPPSASGTPGQRVTISCSGSSSNIGSNTVNWYQQLPGTAPKLLIYSNNQRPSGVPDRFSGSKSGTSASLAIRGLQSDDEAEYYCAAWDDSLKSFVFGKGTKVTVLGGGGGSGGGGSGGGGSQVQLVQSGAEVKKPGASVKVSCKASGYTFSRYYIHWVRQAPGQGLEWMGLINPGGGSTNYAQKFQGRVTMTRDTSTNTVYLELSSLRSDDTAVYYCARDYGTIDARRFDFWGQGTLVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2469 - protein, 492 aa, Artificial Sequence
  source: /note="Description of Artificial Sequence: Synthetic Chimeric Antigen Receptor sequence"
MALPVTALLLPLALLLHAARPQSALTQPASVSGSPGQSITISCTGTSSDFGDYDYVSWYQQHPGKAPKLMIYDVSDRPSGVSNRFSGSKSGNTASLTISGLQAEDEADYFCSSFTTSSTLVFGGGTKLTVLGGGGGSGGGGSGGGGSQVQLVQSGAEVKKPGASVKVSCKASGYTFTGYYMHWVRQAPGQGLEWMGWINPNSGGTNYAQKFQGRVTMTRDTSISTAYMELSRLRSDDTAVYYCARDGDMVYDSSGPDYWGQGTLVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2470 - protein, 494 aa, Artificial Sequence
  source: /note="Description of Artificial Sequence: Synthetic Chimeric Antigen Receptor sequence"
MALPVTALLLPLALLLHAARPQSALTQPPSASGTPGQRVTISCSGSSSNIGSNYVYWYQQLPGTAPKLLIYRNNQRPSGVPDRFSGSKSGTSASLAISGLRSEDEADYYCAAWDDSLSGYVFGTGTKVTVLGGGGGSGGGGSGGGGSQMQLVQSGAEVKKPGASVKVSCKASGYTFSRYYIHWVRQAPGQGLEWMGLINPGGGSTNYAQKFQGRVTMTRDTSTNTVYLELSSLRSDDTAVYYCARDYGTIDARRFDFWGQGTLVTVSSAAATTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2471 - protein, 495 aa, Artificial Sequence
  source: /note="Description of Artificial Sequence: Synthetic Chimeric Antigen Receptor sequence"
MALPVTALLLPLALLLHAARPQSALTQPALTQPASVSGSPGQSITISCTGTSSDFGDYDYVSWYQQHPGKAPKLMIYDVSDRPSGVSNRFSGSKSGNTASLTISGLQAEDEADYFCSSFTTSSTLVFGGGTKLTVLGGGGGSGGGGSGGGGSQVQLVQSGAEVKEPGASVKVSCKASGYTFRNSGITWVRQAPGQGLEWMGWINPNSGGAMYVDNFQGRATMTRDTSINTAYMELRSLSSDDTAVYYCARGMADLIDVFDIWGQGTLVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2472 - protein, 497 aa, Artificial Sequence
  source: /note="Description of Artificial Sequence: Synthetic Chimeric Antigen Receptor sequence"
MALPVTALLLPLALLLHAARPEIVMTQSPATLSVSPGERATLSCRASQSVSSNLAWYQQKPGQAPRLLIYGASTRATGIPARFSGSGSGTEFTLTISSLQSEDFAVYYCQQYNNWPPYTFGQGTKVEIKRGGGGSGGGGSGGGGSQVTLKESGPTLVKPTQTLTLTCTFSGFSLNSFGVAVGWFRQPPGKALEWLGLIYWDDDRRYFPSLEGRLSITKDASDNNVVLTMMNVDPADTATYYCARTSPMVQGIANYYAMDVWGQGTTVTVSSAAATTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2473 - protein, 645 aa, Artificial Sequence
  source: /note="Description of Artificial Sequence: Synthetic Chimeric Antigen Receptor sequence"
EVKLQQSGPELVKPGASVKISCKTSGYTFTEYTMHWVKQSHGKSLEWIGGINPNNGGTSYNQKFKGKATLTVDKSSSTAYMELRSLTSEDSAVYYCALQGFAYWGQGTPLTVSSGGGGSGGGGSGGGGSMEIEITQTPALMSASPGEKVTMTCSASSSVSYMYWYQQKPRSSPKPWIYLTSNLASGVPARFSGSGSGTSYSLTISSMEAEDAATYYCQQWSSNPYTFGGGTRLELKEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2474 - protein, 647 aa, Artificial Sequence
  source: /note="Description of Artificial Sequence: Synthetic Chimeric Antigen Receptor sequence"
QVQLKESGPGLVAPSQTLSITCTVSGFSLTSYGVHWVRQPPGKGLEWLGVIWAGGFTNYNSALKSRLSISKDNSKSQVLLKMTSLQTDDTAMYYCARRGSSYSMDYWGQGTSVTVSSGGGGSGGGGSGGGGSEIVLSQSPAITAASLGQKVTITCSASSNVSYIHWYQQRSGTSPRPWIYEISKLASGVPVRFSGSGSGTSYSLTISSMEAEDAAIYYCQQWNYPLITFGSGTKLEIQEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2475 - protein, 648 aa, Artificial Sequence
  source: /note="Description of Artificial Sequence: Synthetic Chimeric Antigen Receptor sequence"
EVKLQQSGPELVKPGASVKISCKTSGYTFTEYTMHWVKQSHGKSLEWIGGINPNNGGTSYNQKFKGKATLTVDKSSSTAYMELRSLTSEDSAVYYCALQGFAYWGQGTPLTVSSGGGGSGGGGSGGGGSMEIEITQTPALMSASPGEKVTMTCSASSSVSYMYWYQQKPRSSPKPWIYLTSNLASGVPARFSGSGSGTSYSLTISSMEAEDAATYYCQQWSSNPYTFGGGTRLELKEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2476 - protein, 649 aa, Artificial Sequence
  source: /note="Description of Artificial Sequence: Synthetic Chimeric Antigen Receptor sequence"
EVKLVESGGGLVKPGGSLKLSCAASGFTFSSYAMSWVRQTPEKRLEWVASISTGASAYFPDSVKGRFTISRDNARNILYLQMSSLRSEDTAMYYCARITTSTWYFDVWGAGTTVTVSSGGGGSGGGGSGGGGSDIKMTQSPSSMYASLGERVTITCKASQDINSYLSWFQQKPGKSPKTLIYRANRLVDGVPSRFSGSGSGQDYSLTISSLEYEDMGIYYCLQYDEFPYTFGGGTKLEIKEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2477 - protein, 649 aa, Artificial Sequence
  source: /note="Description of Artificial Sequence: Synthetic Chimeric Antigen Receptor sequence"
QVQLQQSGAELVRPGASVTLSCKASGYTFSDYEMHWVIQTPVHGLEWIGAIDPETGGTAYNQKFKGKAILTADKSSSTAYMELRSLTSEDSAVYYCTGYYDYDSFTYWGQGTLVTVSAGGGGSGGGGSGGGGSDIVMTQSQKIMSTTVGDRVSITCKASQNVDAAVAWYQQKPGQSPKLLIYSASNRYTGVPDRFTGSGSGTDFTLTISNMQSEDLADYFCQQYDIYPYTFGGGTKLEIKEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2478 - protein, 650 aa, Artificial Sequence
  source: /note="Description of Artificial Sequence: Synthetic Chimeric Antigen Receptor sequence"
EVKLVESGGGLVKPGGSLKLSCAASGFTFSSYAMSWVRQIPEKRLEWVASISRGGTTYYPDSVKGRFTISRDNVRNILYLQMSSLRSEDTAMYYCGRYDYDGYYAMDYWGQGTSVTVSSGGGGSGGGGSGGGGSDIKMTQSPSSMYASLGERVTITCKASPDINSYLSWFQQKPGKSPKTLIYRANRLVDGVPSRFSGGGSGQDYSLTINSLEYEDMGIYYCLQYDEFPYTFGGGTKLEMKEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2479 - protein, 650 aa, Artificial Sequence
  source: /note="Description of Artificial Sequence: Synthetic Chimeric Antigen Receptor sequence"
EVQLQQSGPELEKPGASVKISCKASGFAFTGYNMNWVKQTNGKSLEWIGSIDPYYGGSTYNQKFKDKATLTVDKSSSTAYMQLKSLTSDDSAVYYCARSPGGDYAMDYWGQGTSVTVSSGGGGSGGGGSGGGGSDIKMTQSPSSMYASVGERVTITCKASQGINSYSGWFQQKPGKSPKTLIYRGNRLVDGVPSRFSGSGSGQDYSLTISSLEYEDMGIYYCLQYDEFPYTFGGGTKLEIKEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2480 - protein, 650 aa, Artificial Sequence
  source: /note="Description of Artificial Sequence: Synthetic Chimeric Antigen Receptor sequence"
QVQLKESGPGLVAPSQTLSITCTVSGFSLTSYGVHWVRQPPGKGLEWLGVIWAGGFTNYNSALKSRLSISKDNSKSQVLLKMTSLQTDDTAMYYCARRGSSYSMDYWGQGTSVTVSSGGGGSGGGGSGGGGSEIVLSQSPAITAASLGQKVTITCSASSNVSYIHWYQQRSGTSPRPWIYEISKLASGVPVRFSGSGSGTSYSLTISSMEAEDAAIYYCQQWNYPLITFGSGTKLEIQEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2481 - protein, 650 aa, Artificial Sequence
  source: /note="Description of Artificial Sequence: Synthetic Chimeric Antigen Receptor sequence"
QVQLQQPGAELVKPGTSVKLSCKASGYNFTNYWINWVKLRPGQGLEWIGEIYPGSGSTNYNEKFKSKATLTADTSSSTAYMQLSSLASEDSALYYCARDGNYYAMDYWGQGTSVTVSSGGGGSGGGGSGGGGSDIQMTQTTSSLSASLGDRVTITCRASQDINNYLNWYQQKPDGTVKLLIYYTSALHSGVPSRFSGSGSGTDYSLTISNLEQEDIATYFCQQGNTLPPYTFGGGTKLEIKEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2482 - protein, 651 aa, Artificial Sequence
  source: /note="Description of Artificial Sequence: Synthetic Chimeric Antigen Receptor sequence"
EVKLQESGAELARPGASVKMSCKASGYTFTSYTMHWVKQRPGQGLEWIGYINPSSGYTEYNQKFKDKTTLTADKSSSTAYMQLSSLTSGDSAVYYCARRVLWLRRGDYWGQGTILTVSAGGGGSGGGGSGGGGSMEVLITQTPSSLSASLGERVSLTCRASQDIGSSLNWLQQEPDGTIKRLIYATSSLDSGVPKRFSGSRSGSDYSLTISSLESEDFVDYYCLQYASSPYTFGGGTKLELKEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2483 - protein, 652 aa, Artificial Sequence
  source: /note="Description of Artificial Sequence: Synthetic Chimeric Antigen Receptor sequence"
EVKLVESGGGLVKPGGSLKLSCAASGFTFSSYAMSWVRQTPEKRLEWVASISTGASAYFPDSVKGRFTISRDNARNILYLQMSSLRSEDTAMYYCARITTSTWYFDVWGAGTTVTVSSGGGGSGGGGSGGGGSDIKMTQSPSSMYASLGERVTITCKASQDINSYLSWFQQKPGKSPKTLIYRANRLVDGVPSRFSGSGSGQDYSLTISSLEYEDMGIYYCLQYDEFPYTFGGGTKLEIKEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2484 - protein, 652 aa, Artificial Sequence
  source: /note="Description of Artificial Sequence: Synthetic Chimeric Antigen Receptor sequence"
QVQLQQSGAELVRPGASVTLSCKASGYTFSDYEMHWVIQTPVHGLEWIGAIDPETGGTAYNQKFKGKAILTADKSSSTAYMELRSLTSEDSAVYYCTGYYDYDSFTYWGQGTLVTVSAGGGGSGGGGSGGGGSDIVMTQSQKIMSTTVGDRVSITCKASQNVDAAVAWYQQKPGQSPKLLIYSASNRYTGVPDRFTGSGSGTDFTLTISNMQSEDLADYFCQQYDIYPYTFGGGTKLEIKEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2485 - protein, 653 aa, Artificial Sequence
  source: /note="Description of Artificial Sequence: Synthetic Chimeric Antigen Receptor sequence"
EVKLVESGGGLVKPGGSLKLSCAASGFTFSSYAMSWVRQIPEKRLEWVASISRGGTTYYPDSVKGRFTISRDNVRNILYLQMSSLRSEDTAMYYCGRYDYDGYYAMDYWGQGTSVTVSSGGGGSGGGGSGGGGSDIKMTQSPSSMYASLGERVTITCKASPDINSYLSWFQQKPGKSPKTLIYRANRLVDGVPSRFSGGGSGQDYSLTINSLEYEDMGIYYCLQYDEFPYTFGGGTKLEMKEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2486 - protein, 653 aa, Artificial Sequence
  source: /note="Description of Artificial Sequence: Synthetic Chimeric Antigen Receptor sequence"
EVQLQQSGPELEKPGASVKISCKASGFAFTGYNMNWVKQTNGKSLEWIGSIDPYYGGSTYNQKFKDKATLTVDKSSSTAYMQLKSLTSDDSAVYYCARSPGGDYAMDYWGQGTSVTVSSGGGGSGGGGSGGGGSDIKMTQSPSSMYASVGERVTITCKASQGINSYSGWFQQKPGKSPKTLIYRGNRLVDGVPSRFSGSGSGQDYSLTISSLEYEDMGIYYCLQYDEFPYTFGGGTKLEIKEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2487 - protein, 653 aa, Artificial Sequence
  source: /note="Description of Artificial Sequence: Synthetic Chimeric Antigen Receptor sequence"
QVQLQQPGAELVKPGTSVKLSCKASGYNFTNYWINWVKLRPGQGLEWIGEIYPGSGSTNYNEKFKSKATLTADTSSSTAYMQLSSLASEDSALYYCARDGNYYAMDYWGQGTSVTVSSGGGGSGGGGSGGGGSDIQMTQTTSSLSASLGDRVTITCRASQDINNYLNWYQQKPDGTVKLLIYYTSALHSGVPSRFSGSGSGTDYSLTISNLEQEDIATYFCQQGNTLPPYTFGGGTKLEIKEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2488 - protein, 654 aa, Artificial Sequence
  source: /note="Description of Artificial Sequence: Synthetic Chimeric Antigen Receptor sequence"
EVKLQESGAELARPGASVKMSCKASGYTFTSYTMHWVKQRPGQGLEWIGYINPSSGYTEYNQKFKDKTTLTADKSSSTAYMQLSSLTSGDSAVYYCARRVLWLRRGDYWGQGTILTVSAGGGGSGGGGSGGGGSMEVLITQTPSSLSASLGERVSLTCRASQDIGSSLNWLQQEPDGTIKRLIYATSSLDSGVPKRFSGSRSGSDYSLTISSLESEDFVDYYCLQYASSPYTFGGGTKLELKEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2489 - protein, 669 aa, Artificial Sequence
  source: /note="Description of Artificial Sequence: Synthetic Chimeric Antigen Receptor sequence"
MALPVTALLLPLALLLHAARPQVQLQESGPGLVKPSETLSLTCTVSGFSLTSYGYVHWVRQPPGKGLEWLGVIWAGGFTNYNPSLKSRLTISKDNSKNQVSLKLSSVTAADTAVYYCARRGSSYSMDYWGQGTLVTVSSGGGGSGGGGSGGGGSEIVLTQSPATLSLSPGERATLSCRASSNVSYIHWYQQKPGQAPRPWIYEISKLATGIPARFSGSGSGTDYTLTISSLEPEDFAVYYCQQWNYPLITFGQGTKLEIKEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2490 - protein, 670 aa, Artificial Sequence
  source: /note="Description of Artificial Sequence: Synthetic Chimeric Antigen Receptor sequence"
MALPVTALLLPLALLLHAARPEVQLVESGGGLVKPGGSLRLSCAASGFTFSSYAMSWVRQAPGKGLEWVASISTGASAYFADSVKGRFTISRDNAKNSLYLQMNSLRAEDTAVYYCARITTSTWYFDVWGQGTTVTVSSGGGGSGGGGSGGGGSDIQMTQSPSSLSASVGDRVTITCRASQDINSYLSWFQQKPGKAPKTLIYRANRLQSGVPSRFSGSGSGQDYTLTISSLQPEDFATYYCLQYDEFPYTFGQGTKLEIKEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2491 - protein, 672 aa, Artificial Sequence
  source: /note="Description of Artificial Sequence: Synthetic Chimeric Antigen Receptor sequence"
MALPVTALLLPLALLLHAARPQVQLQESGPGLVKPSETLSLTCTVSGFSLTSYGYVHWVRQPPGKGLEWLGVIWAGGFTNYNPSLKSRLTISKDNSKNQVSLKLSSVTAADTAVYYCARRGSSYSMDYWGQGTLVTVSSGGGGSGGGGSGGGGSEIVLTQSPATLSLSPGERATLSCRASSNVSYIHWYQQKPGQAPRPWIYEISKLATGIPARFSGSGSGTDYTLTISSLEPEDFAVYYCQQWNYPLITFGQGTKLEIKEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2492 - protein, 673 aa, Artificial Sequence
  source: /note="Description of Artificial Sequence: Synthetic Chimeric Antigen Receptor sequence"
MALPVTALLLPLALLLHAARPEVQLVESGGGLVKPGGSLRLSCAASGFTFSSYAMSWVRQAPGKGLEWVASISTGASAYFADSVKGRFTISRDNAKNSLYLQMNSLRAEDTAVYYCARITTSTWYFDVWGQGTTVTVSSGGGGSGGGGSGGGGSDIQMTQSPSSLSASVGDRVTITCRASQDINSYLSWFQQKPGKAPKTLIYRANRLQSGVPSRFSGSGSGQDYTLTISSLQPEDFATYYCLQYDEFPYTFGQGTKLEIKEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2493 - protein, 689 aa, Artificial Sequence
  source: /note="Description of Artificial Sequence: Synthetic Chimeric Antigen Receptor sequence"
TAMDFQVQIFSFLLISASVIMSREVQLVETGGGLVQPGKSLELTCATSGFTFNTAWMHWVRQSPDKRLEWIARIKDTSNNYATDYVESMKGRFTISRDDSKGSVNLQMNSLKEEDTATYYCTTDFYDGTYYWNYWGQGVMVTVSSGGGGSGGGGSGGGGSSYELIQPPSAAVTLGNTVSLTCVGDELPKRYAYWYQQKPDQSIVRVIYEDSVRPPGISDRFSGSSSGTTATLTIRDAQNEDEADYYCQSTYGDDKLYIFGGGTKLTVLGDPAEPKSPDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKKDPKFWVLVVVGGVLACYSLLVTVAFIIFWVRSKRSRLLHSDYMNMTPRRPGPTRKHYQPYAPPRDFAAYRSLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2494 - protein, 679 aa, Artificial Sequence
  source: /note="Description of Artificial Sequence: Synthetic Chimeric Antigen Receptor sequence"
MDFQVQIFSFLLISASVIMSRQVQLKESGPGLVAPSQSLSITCTVSGFSLSSQGVYWVRQPPGKGLEWLGAIWAGGSTNYNSALMSRLSISKDNSKSQVFLKMNSLQTDDTAMYYCARVDGYRGYNMDYWGQGTSVTVSSGGGGSGGGGSGGGGSENVLTQSPAIMSASPGEKVTMTCSASSSVSYMHWYQQKSSTSPKLWIYDTSKLASGVPGRFSGSGSGNSYSLTISSMEAEDVATYYCFQGSGYPLTFGAGTKLELKAAALPAEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSSLSPGKKIYIWAPLAGTCGVLLLSLVITLYCKRGRKKLLYIFKQPFMRPVQTTQEEDGCSCRFPEEEEGGCELLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2495 - protein, 383 aa, Artificial Sequence
  source: /note="Description of Artificial Sequence: Synthetic polypeptide"
MALPVTALLLPLALLLHAARPQVQLQQSGPELEKPGASVKISCKASGYSFTGYTMNWVKQSHGKSLEWIGLITPYNGASSYNQKFRGKATLTVDKSSSTAYMDLLSLTSEDSAVYFCARGGYDGRGFDYWGQGTTVTVSSGGGGSGGGGSGGGGSDIELTQSPAIMSASPGEKVTMTCSASSSVSYMHWYQQKSGTSPKRWIYDTSKLASGVPGRFSGSGSGNSYSLTISSVEAEDDATYYCQQWSGYPLTFGAGTKLEITTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPA

SEQ ID NO: 2496 - protein, 458 aa, Artificial Sequence
  source: /note="Description of Artificial Sequence: Synthetic Chimeric Antigen Receptor sequence"
MALPVTALLLPLALLLHAARPEVQLQQSGPDLVKPGASVKISCKASGYSFTGYYMHWVKQSHGKSLEWIGRINPNNGVTLYNQKFKDKAILTVDKSSTTAYMELRSLTSEDSAVYYCARSTMITNYVMDYWGQVTSVTVSSGGGGSGGGGSGGGGSSIVMTQTPTFLLVSAGDRVTITCKASQSVSNDVAWYQQKPGQSPTLLISYTSSRYAGVPDRFIGSGYGTDFTFTISTLQAEDLAVYFCQQDYNSPPTFGGGTKLEIKRGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2497 - protein, 679 aa, Artificial Sequence
  source: /note="Description of Artificial Sequence: Synthetic Chimeric Antigen Receptor sequence"
MDFQVQIFSFLLISASVIMSRENVLTQSPAIMSASPGEKVTMTCSASSSVSYMHWYQQKSSTSPKLWIYDTSKLASGVPGRFSGSGSGNSYSLTISSMEAEDVATYYCFQGSGYPLTFGAGTKLELKGGGGSGGGGSGGGGSQVQLKESGPGLVAPSQSLSITCTVSGFSLSSQGVYWVRQPPGKGLEWLGAIWAGGSTNYNSALMSRLSISKDNSKSQVFLKMNSLQTDDTAMYYCARVDGYRGYNMDYWGQGTSVTVSSAAALPAEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSSLSPGKKIYIWAPLAGTCGVLLLSLVITLYCKRGRKKLLYIFKQPFMRPVQTTQEEDGCSCRFPEEEEGGCELLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2498 - protein, 1345 aa, Artificial Sequence
  source: /note="Description of Artificial Sequence: Synthetic Chimeric Antigen Receptor sequence"
MSLPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITKAGGGGSGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSDPTTTPAPRPPTPAPTIASQPLSLRPEACRPAAGGAVHTRGLDFACDIFVLVWGGVLACYSLLVTVAFIIFVVVRRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRRAEGRGSLLTCGDVEENPGPMAVPTQVLGLLLLWLTDARCDIQMTQSPSSLSASVGDRVTITCRASEDIYFNLVWYQQKPGKAPKLLIYDTNRLADGVPSRFSGSGSGTQYTLTISSLQPEDFATYYCQHYKNYPLTFGQGTKLEIKRSGGGGSGGGGSGGGGSGGGGSRSEVQLVESGGGLVQPGGSLRLSCAASGFTLSNYGMHWIRQAPGKGLEWVSSISLNGGSTYYRDSVKGRFTISRDNAKSTLYLQMNSLRAEDTAVYYCAAQDAYTGGYFDYWGQGTLVTVSSMDPAEPKSPDKTHTCPPCPAPPVAGPSVFLFPPKPKDTLMIARTPEVTCVWDVSHEDPEVKFNWYVDGVEVHNAKTKPREEQYNSTYRWSVLTVLHQDWLNGKEYKCKVSNALPAPIEKTISKAKGQPREPQVYTLPPSRDELTNQVSLTCLVKGFYPSDIAVEWESNGQPENNYKTTPPVLDSDGSFFLYSKLTVDKSRWQQGNVFSCSVMHEALHNHYTQKSLSLSPGKKDPKAVFGCIFGALVIVTVGGFIFWRKKRKDAKNNEVSFSQIKPKKSKLIRVENFEAYFKKQQADSNCGFAEEYEDLKLVGISQPKYAAELAENRGKNRYNNVLPYDISRVKLSVQTHSTDDYINANYMPGYHSKKDFIATQGPLPNTLKDFWRMVWEKNVYAIIMLTKCVEQGRTKCEEYWPSKQAQDYGDITVAMTSEIVLPEWTIRDFTVKNIQTSESHPLRQFHFTSWPDHGVPDTTDLLINFRYLVRDYMKQSPPESPILVHCSAGVGRTGTFIAIDRLIYQIENENTVDVYGIVYDLRMHRPLMVQTEDQYVFLNQCVLDIVRSQKDSKVDLIYQNTTAMTIYENLAPVTTFGKTNGYIA

SEQ ID NO: 2499 - protein, 912 aa, Artificial Sequence
  source: /note="Description of Artificial Sequence: Synthetic Chimeric Antigen Receptor sequence"
SLPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITKAGGGGSGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSDPTTTPAPRPPTPAPTIASQPLSLRPEACRPAAGGAVHTRGLDFACDIFVWLVWGGVLACYSLLVTVAFIIFWVRRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRRAEGRGSLLTCGDVEENPGPMAVPTQVLGLLLLWLTDARCDIQMTQSPSSLSASVGDRVTITCRASEDIYFNLVWYQQKPGKAPKLLIYDTNRLADGVPSRFSGSGSGTQYTLTISSLQPEDFATYYCQHYKNYPLTFGQGTKLEIKRSGGGGSGGGGSGGGGSGGGGSRSEVQLVESGGGLVQPGGSLRLSCAASGFTLSNYGMHWIRQAPGKGLEWVSSISLNGGSTYYRDSVKGRFTISRDNAKSTLYLQNSLRAEDTAVYYCAAQDAYTGGYFDYWGQGTLVTVSSMDPATTTKPVLRTPSPVHPTGTSQPQRPEDCRPRGSVKGTGLDFACDILIGVSWFLFCLLLLVLFCLHRQNQIKQGPPRSKDEEQKPQQRPDLAVDVLERTADKANGLPEKDRETDTSALAAGSSQEVTYAQLDHWALTQRTARAVSPQSTKPMAESITYAAVARH

SEQ ID NO: 2500 - protein, 1112 aa, Artificial Sequence
  source: /note="Description of Artificial Sequence: Synthetic Chimeric Antigen Receptor sequence"
MSLPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITKAGGGGSGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSDPTTTPAPRPPTPAPTIASQPLSLRPEACRPAAGGAVHTRGLDFACDIFVWLWVGGVLACYSLLVTVAFIIFVWRRVKFSRSADAPAYQQGQNQLYNELNLGRREEYDVLDKRRGRDPEGGKPRRKNPQEGLYNELQKDKMAEAYSEIGKGERRRGKGHDGLYQGLSTATKDTYDALHMQALPPRRAEGRGSLLTCGDVEENPGPMAVPTQVLGLLLLWLTDARCDIQMTQSPSSLSASVGDRVTITCRASEDIYFNLNAAYQQKPGKAPKLLIYDTNRLADGVPSRFSGSGSGTQYTLTISSLQPEDFATYYCQHYKNYPLTFGQGTKLEIKRSGGGGSGGGGSGGGGSGGGGSRSEVQLVESGGGLVQPGGSLRLSCAASGFTLSNYGMHWIRQAPGKGLEWVSSISLNGGSTYYRDSVKGRFTISRDNAKSTLYLQMNSLRAEDTAVYYCAAQDAYTGGYFDYWGQGTLVTVSSMDPATTTKPVLRTPSPVHPTGTSQPQRPEDCRPRGSVKGTGLDFACDIYWAPLAGICVALLLSLIITLICYHRSRKRVCKSGGGSFWEEFESLQKQEVKNLHQRLEGQRPENKGKNRYKNILPFDHSRVILQGRDSNIPGSDYINANYIKNQLLGPDENAKTYIASQGCLEATVNDFWQMAWQENSRVIVMTTREVEKGRNKCVPYWPEVGMQRAYGPYSVTNCGEHDTTEYKLRTLQVSPLDNGDLIREIWHYQYLSWPDHGVPSEPGGVLSFLDQINQRQESLPHAGPIIVHCSAGIGRTGTIIVIDMLMENISTKGLDCDIDIQKTIQMVRAQRSGMVQTEAQYKFIYVAIAQFIETTKKKL

SEQ ID NO: 2501 - protein, 1363 aa, Artificial Sequence
  source: /note="Description of Artificial Sequence: Synthetic Chimeric Antigen Receptor sequence"
MSLPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITKAGGGGSGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSDPTTTPAPRPPTPAPTIASQPLSLRPEACRPAAGGAVHTRGLDFACDIFWVLVVVGGVLACYSLLVTVAFIIFWVRRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRRAEGRGSLLTCGDVEENPGPMAVPTQVLGLLLLWLTDARCDIQMTQSPSSLSASVGDRVTITCRASEDIYFNLVWYQQKPGKAPKLLIYDTNRLADGVPSRFSGSGSGTQYTLTISSLQPEDFATYYCQHYKNYPLTFGQGTKLEIKRSGGGGSGGGGSGGGGSGGGGSRSEVQLVESGGGLVQPGGSLRLSCAASGFTLSNYGMHWIRQAPGKGLEWVSSISLNGGSTYYRDSVKGRFTISRDNAKSTLYLQMNSLRAEDTAVYYCAAQDAYTGGYFDYWGQGTLVTVSSMDPATTTKPVLRTPSPVHPTGTSQPQRPEDCRPRGSVKGTGLDFACDILIGVSVVFLFCLLLLVLFCLHRQNQIKQGPPRSKDEEQKPQQRPDLAVDVLERTADKATVNGLPEKDRETDTSALAAGSSQEVTYAQLDHWALTQRTARAVSPQSTKPMAESITYAAVARHRAEGRGSLLTCGDVEENPGPWYHGHMSGGQAETLLQAKGEPWTFLVRESLSQPGDFVLSVLSDQPKAGPGSPLRVTHIKVMCEGGRYTVGGLETFDSLTDLVEHFKKTGIEEASGAFVYLRQPYSGGGGSFEAYFKKQQADSNCGFAEEYEDLKLVGISQPKYAAELAENRGKNRYNNVLPYDISRVKLSVQTHSTDDYINANYMPGYHSKKDFIATQGPLPNTLKDFWRMVWEKNVYAIIMLTKCVEQGRTKCEEYWPSKQAQDYGDITVAMTSEIVLPEWTIRDFTVKNIQTSESHPLRQFHFTSWPDHGVPDTTDLLINFRYLVRDYMKQSPPESPILVHCSAGVGRTGTFIAIDRLIYQIENENTVDVYGIVYDLRMHRPLMVQTEDQYVFLNQCVLDIVRSQKDSKVDLIYQNTTAMTIYENLAPVTTFGKTNGYIASGS

SEQ ID NO: 2502 - protein, 489 aa, Artificial Sequence
  source: /note="Description of Artificial Sequence: Synthetic Chimeric Antigen Receptor sequence"
MALPVTALLLPLALLLHAARPQVTLKESGPGILKPSQTLSLTCSFSGFSLSTSGMGVGWIRQPSGKGLEWLAHIWWDDDKYYNPSLKSQLTISKDTSRNQVFLKITSVDTADTATYYCSRRPRGTMDAMDYWGQGTSVTVSSGGGGSGGGGSGGGGSDIVMTQAASSLSASLGDRVTISCRASQDISKYLNWYQQKPDGTVKLLIYYTSRLHSGVPSRFSGSGSGTDYSLTIRNLEQEDIATYFCQQVYTLPWTFGGGTKLEIKSGTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2503 - protein, 455 aa, Artificial Sequence
  source: /note="Description of Artificial Sequence: Synthetic Chimeric Antigen Receptor sequence"
MALPVTALLLPLALLLHAARPQIQLVQSGPELKKPGETVKISCKASGYTFTNFGMNWVKQGPGEGLKWMGWINTNTGEPRYAEEFKGRFAFSLETTASTAYLQINNLKNEDTATYFCARDWDGAYFFDYWGQGTTLTVSSGGGSGGGGSGGGGSSIVMTQTPKFLLVSAGDRVTITCKASQSVSNDVAWYQQKPGQSPKLLINFATNRYTGVPNRFTGSGYGTDFTFTISTVQAEDLALYFCQQDYSSPWTFGGGTKLEIKGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2504 - protein, 455 aa, Artificial Sequence
  source: /note="Description of Artificial Sequence: Synthetic Chimeric Antigen Receptor sequence"
MALPVTALLLPLALLLHAARPQVQLQQSRPELVKPGASVKMSCKASGYTFTDYVISWVKQRTGQGLEWIGEIYPGSNSIYYNEKFKGRATLTADKSSSTAYMQLSSLTSEDSAVYFCAMGGNYGFDYWGQGTTLTVSSGGGGSGGGGSGGGGSQIVLTQSPAIMSASLGERVTLTCTASSSVNSNYLHWYQQKPGSSPKLWIYSTSNLASGVPARFSGSGSGTSYSLTISSMEAEDAATYYCHQYHRSPLTFGAGTKLELKGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2505 - protein, 458 aa, Artificial Sequence
  source: /note="Description of Artificial Sequence: Synthetic Chimeric Antigen Receptor sequence"
MALPVTALLLPLALLLHAARPQIQLVQSGPELKKPGETVKISCKASGYTFTNFGMNWVKQGPGEGLKWMGWINTNTGEPRYAEEFKGRFAFSLETTASTAYLQINNLKNEDTATYFCARDWDGAYFFDYWGQGTTLTVSSGGGSGGGGSGGGGSSIVMTQTPKFLLVSAGDRVTITCKASQSVSNDVAWYQQKPGQSPKLLINFATNRYTGVPNRFTGSGYGTDFTFTISTVQAEDLALYFCQQDYSSPWTFGGGTKLEIKGLAVSTISSFFPPGYQIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2506 - protein, 458 aa, Artificial Sequence
  source: /note="Description of Artificial Sequence: Synthetic Chimeric Antigen Receptor sequence"
MALPVTALLLPLALLLHAARPQVQLQQSRPELVKPGASVKMSCKASGYTFTDYVISWVKQRTGQGLEWIGEIYPGSNSIYYNEKFKGRATLTADKSSSTAYMQLSSLTSEDSAVYFCAMGGNYGFDYWGQGTTLTVSSGGGGSGGGGSGGGGSQIVLTQSPAIMSASLGERVTLTCTASSSVNSNYLHWYQQKPGSSPKLWIYSTSNLASGVPARFSGSGSGTSYSLTISSMEAEDAATYYCHQYHRSPLTFGAGTKLELKGLAVSTISSFFPPGYQIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2507 - protein, 459 aa, Artificial Sequence
  source: /note="Description of Artificial Sequence: Synthetic Chimeric Antigen Receptor sequence"
MALPVTALLLPLALLLHAARPEVQLVESGGGLVQPKGSLKLSCAASGFTFNTYAMNWVRQAPGKGLEWVARIRSKSNNYATYYADSVKDRFTISRDDSQSMLYLQMNNLKTEDTAMYYCVRQWDYDVRAMNYWGQGTSVTVSSGGGGSGGGGSGGGGSDIVMTQSHIFMSTSVGDRVSITCKASQDVDTAVAWYQQKPGQSPKLLIYWASTRLTGVPDRFTGSGSGTDFTLTISNVQSEDLADYFCQQYSSYPYTFGGGTKLEIKGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2508 - protein, 461 aa, Artificial Sequence
  source: /note="Description of Artificial Sequence: Synthetic Chimeric Antigen Receptor sequence"
MALPVTALLLPLALLLHAARPEVQLQQSGPDLVKPGASVKISCKASGYSFTGYYMHWVKQSHGKSLEWIGRINPNNGVTLYNQKFKDKAILTVDKSSTTAYMELRSLTSEDSAVYYCARSTMITNYVMDYWGQVTSVTVSSGGGGSGGGGSGGGGSSIVMTQTPTFLLVSAGDRVTITCKASQSVSNDVAWYQQKPGQSPTLLISYTSSRYAGVPDRFIGSGYGTDFTFTISTLQAEDLAVYFCQQDYNSPPTFGGGTKLEIKRGLAVSTISSFFPPGYQIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2509 - protein, 462 aa, Artificial Sequence
  source: /note="Description of Artificial Sequence: Synthetic Chimeric Antigen Receptor sequence"
MALPVTALLLPLALLLHAARPEVQLVESGGGLVQPKGSLKLSCAASGFTFNTYAMNWVRQAPGKGLEWVARIRSKSNNYATYYADSVKDRFTISRDDSQSMLYLQMNNLKTEDTAMYYCVRQWDYDVRAMNYWGQGTSVTVSSGGGGSGGGGSGGGGSDIVMTQSHIFMSTSVGDRVSITCKASQDVDTAVAWYQQKPGQSPKLLIYWASTRLTGVPDRFTGSGSGTDFTLTISNVQSEDLADYFCQQYSSYPYTFGGGTKLEIKGLAVSTISSFFPPGYQIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2510 - protein, 484 aa, Artificial Sequence
  source: /note="Description of Artificial Sequence: Synthetic Chimeric Antigen Receptor sequence"
MALPVTALLLPLALLLHAARPQIQLVQSGPELKKPGETVKISCKASGYTFTNFGMNWVKQGPGEGLKWMGWINTNTGEPRYAEEFKGRFAFSLETTASTAYLQINNLKNEDTATYFCARDWDGAYFFDYWGQGTTLTVSSGGGSGGGGSGGGGSSIVMTQTPKFLLVSAGDRVTITCKASQSVSNDVAWYQQKPGQSPKLLINFATNRYTGVPNRFTGSGYGTDFTFTISTVQAEDLALYFCQQDYSSPWTFGGGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2511 - protein, 484 aa, Artificial Sequence
  source: /note="Description of Artificial Sequence: Synthetic Chimeric Antigen Receptor sequence"
MALPVTALLLPLALLLHAARPQVQLQQSRPELVKPGASVKMSCKASGYTFTDYVISWVKQRTGQGLEWIGEIYPGSNSIYYNEKFKGRATLTADKSSSTAYMQLSSLTSEDSAVYFCAMGGNYGFDYWGQGTTLTVSSGGGGSGGGGSGGGGSQIVLTQSPAIMSASLGERVTLTCTASSSVNSNYLHWYQQKPGSSPKLWIYSTSNLASGVPARFSGSGSGTSYSLTISSMEAEDAATYYCHQYHRSPLTFGAGTKLELKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2512 - protein, 487 aa, Artificial Sequence
  source: /note="Description of Artificial Sequence: Synthetic Chimeric Antigen Receptor sequence"
MALPVTALLLPLALLLHAARPEVQLQQSGPDLVKPGASVKISCKASGYSFTGYYMHWVKQSHGKSLEWIGRINPNNGVTLYNQKFKDKAILTVDKSSTTAYMELRSLTSEDSAVYYCARSTMITNYVMDYWGQVTSVTVSSGGGGSGGGGSGGGGSSIVMTQTPTFLLVSAGDRVTITCKASQSVSNDVAWYQQKPGQSPTLLISYTSSRYAGVPDRFIGSGYGTDFTFTISTLQAEDLAVYFCQQDYNSPPTFGGGTKLEIKRTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2513 - protein, 487 aa, Artificial Sequence
  source: /note="Description of Artificial Sequence: Synthetic Chimeric Antigen Receptor sequence"
MALPVTALLLPLALLLHAARPQIQLVQSGPELKKPGETVKISCKASGYTFTNFGMNWVKQGPGEGLKWMGWINTNTGEPRYAEEFKGRFAFSLETTASTAYLQINNLKNEDTATYFCARDWDGAYFFDYWGQGTTLTVSSGGGSGGGGSGGGGSSIVMTQTPKFLLVSAGDRVTITCKASQSVSNDVAWYQQKPGQSPKLLINFATNRYTGVPNRFTGSGYGTDFTFTISTVQAEDLALYFCQQDYSSPWTFGGGTKLEIKTTTPAPRPPTPAPTIASQPLSLRPEACRPAAGGAVHTRGLDFACDIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2514 - protein, 487 aa, Artificial Sequence
  source: /note="Description of Artificial Sequence: Synthetic Chimeric Antigen Receptor sequence"
MALPVTALLLPLALLLHAARPQVQLQQSRPELVKPGASVKMSCKASGYTFTDYVISWVKQRTGQGLEWIGEIYPGSNSIYYNEKFKGRATLTADKSSSTAYMQLSSLTSEDSAVYFCAMGGNYGFDYWGQGTTLTVSSGGGGSGGGGSGGGGSQIVLTQSPAIMSASLGERVTLTCTASSSVNSNYLHWYQQKPGSSPKLWIYSTSNLASGVPARFSGSGSGTSYSLTISSMEAEDAATYYCHQYHRSPLTFGAGTKLELKTTTPAPRPPTPAPTIASQPLSLRPEACRPAAGGAVHTRGLDFACDIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2515 - protein, 488 aa, Artificial Sequence
  source: /note="Description of Artificial Sequence: Synthetic Chimeric Antigen Receptor sequence"
MALPVTALLLPLALLLHAARPEVQLVESGGGLVQPKGSLKLSCAASGFTFNTYAMNWVRQAPGKGLEWVARIRSKSNNYATYYADSVKDRFTISRDDSQSMLYLQMNNLKTEDTAMYYCVRQWDYDVRAMNYWGQGTSVTVSSGGGGSGGGGSGGGGSDIVMTQSHIFMSTSVGDRVSITCKASQDVDTAVAWYQQKPGQSPKLLIYWASTRLTGVPDRFTGSGSGTDFTLTISNVQSEDLADYFCQQYSSYPYTFGGGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2516 - protein, 490 aa, Artificial Sequence
  source: /note="Description of Artificial Sequence: Synthetic Chimeric Antigen Receptor sequence"
MALPVTALLLPLALLLHAARPEVQLQQSGPDLVKPGASVKISCKASGYSFTGYYMHWVKQSHGKSLEWIGRINPNNGVTLYNQKFKDKAILTVDKSSTTAYMELRSLTSEDSAVYYCARSTMITNYVMDYWGQVTSVTVSSGGGGSGGGGSGGGGSSIVMTQTPTFLLVSAGDRVTITCKASQSVSNDVAWYQQKPGQSPTLLISYTSSRYAGVPDRFIGSGYGTDFTFTISTLQAEDLAVYFCQQDYNSPPTFGGGTKLEIKRTTTPAPRPPTPAPTIASQPLSLRPEACRPAAGGAVHTRGLDFACDIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2517 - protein, 491 aa, Artificial Sequence
  source: /note="Description of Artificial Sequence: Synthetic Chimeric Antigen Receptor sequence"
MALPVTALLLPLALLLHAARPEVQLVESGGGLVQPKGSLKLSCAASGFTFNTYAMNWVRQAPGKGLEWVARIRSKSNNYATYYADSVKDRFTISRDDSQSMLYLQMNNLKTEDTAMYYCVRQWDYDVRAMNYWGQGTSVTVSSGGGGSGGGGSGGGGSDIVMTQSHIFMSTSVGDRVSITCKASQDVDTAVAWYQQKPGQSPKLLIYWASTRLTGVPDRFTGSGSGTDFTLTISNVQSEDLADYFCQQYSSYPYTFGGGTKLEIKTTTPAPRPPTPAPTIASQPLSLRPEACRPAAGGAVHTRGLDFACDIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2518 - protein, 670 aa, Artificial Sequence
  source: /note="Description of Artificial Sequence: Synthetic Chimeric Antigen Receptor sequence"
MALPVTALLLPLALLLHAARPQIQLVQSGPELKKPGETVKISCKASGYTFTNFGMNWVKQGPGEGLKWMGWINTNTGEPRYAEEFKGRFAFSLETTASTAYLQINNLKNEDTATYFCARDWDGAYFFDYWGQGTTLTVSSGGGSGGGGSGGGGSSIVMTQTPKFLLVSAGDRVTITCKASQSVSNDVAWYQQKPGQSPKLLINFATNRYTGVPNRFTGSGYGTDFTFTISTVQAEDLALYFCQQDYSSPWTFGGGTKLEIKEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2519 - protein, 670 aa, Artificial Sequence
  source: /note="Description of Artificial Sequence: Synthetic Chimeric Antigen Receptor sequence"
MALPVTALLLPLALLLHAARPQVQLQQSRPELVKPGASVKMSCKASGYTFTDYVISWVKQRTGQGLEWIGEIYPGSNSIYYNEKFKGRATLTADKSSSTAYMQLSSLTSEDSAVYFCAMGGNYGFDYWGQGTTLTVSSGGGGSGGGGSGGGGSQIVLTQSPAIMSASLGERVTLTCTASSSVNSNYLHWYQQKPGSSPKLWIYSTSNLASGVPARFSGSGSGTSYSLTISSMEAEDAATYYCHQYHRSPLTFGAGTKLELKEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2520 - protein, 673 aa, Artificial Sequence
  source: /note="Description of Artificial Sequence: Synthetic Chimeric Antigen Receptor sequence"
MALPVTALLLPLALLLHAARPQIQLVQSGPELKKPGETVKISCKASGYTFTNFGMNWVKQGPGEGLKWMGWINTNTGEPRYAEEFKGRFAFSLETTASTAYLQINNLKNEDTATYFCARDWDGAYFFDYWGQGTTLTVSSGGGSGGGGSGGGGSSIVMTQTPKFLLVSAGDRVTITCKASQSVSNDVAWYQQKPGQSPKLLINFATNRYTGVPNRFTGSGYGTDFTFTISTVQAEDLALYFCQQDYSSPWTFGGGTKLEIKEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2521 - protein, 673 aa, Artificial Sequence
  source: /note="Description of Artificial Sequence: Synthetic Chimeric Antigen Receptor sequence"
MALPVTALLLPLALLLHAARPQVQLQQSRPELVKPGASVKMSCKASGYTFTDYVISWVKQRTGQGLEWIGEIYPGSNSIYYNEKFKGRATLTADKSSSTAYMQLSSLTSEDSAVYFCAMGGNYGFDYWGQGTTLTVSSGGGGSGGGGSGGGGSQIVLTQSPAIMSASLGERVTLTCTASSSVNSNYLHWYQQKPGSSPKLWIYSTSNLASGVPARFSGSGSGTSYSLTISSMEAEDAATYYCHQYHRSPLTFGAGTKLELKEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2522 - protein, 674 aa, Artificial Sequence
  source: /note="Description of Artificial Sequence: Synthetic Chimeric Antigen Receptor sequence"
MALPVTALLLPLALLLHAARPEVQLVESGGGLVQPKGSLKLSCAASGFTFNTYAMNWVRQAPGKGLEWVARIRSKSNNYATYYADSVKDRFTISRDDSQSMLYLQMNNLKTEDTAMYYCVRQWDYDVRAMNYWGQGTSVTVSSGGGGSGGGGSGGGGSDIVMTQSHIFMSTSVGDRVSITCKASQDVDTAVAWYQQKPGQSPKLLIYWASTRLTGVPDRFTGSGSGTDFTLTISNVQSEDLADYFCQQYSSYPYTFGGGTKLEIKEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2523 - protein, 676 aa, Artificial Sequence
  source: /note="Description of Artificial Sequence: Synthetic Chimeric Antigen Receptor sequence"
MALPVTALLLPLALLLHAARPEVQLQQSGPDLVKPGASVKISCKASGYSFTGYYMHWVKQSHGKSLEWIGRINPNNGVTLYNQKFKDKAILTVDKSSTTAYMELRSLTSEDSAVYYCARSTMITNYVMDYWGQVTSVTVSSGGGGSGGGGSGGGGSSIVMTQTPTFLLVSAGDRVTITCKASQSVSNDVAWYQQKPGQSPTLLISYTSSRYAGVPDRFIGSGYGTDFTFTISTLQAEDLAVYFCQQDYNSPPTFGGGTKLEIKREPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2524 - protein, 677 aa, Artificial Sequence
  source: /note="Description of Artificial Sequence: Synthetic Chimeric Antigen Receptor sequence"
MALPVTALLLPLALLLHAARPEVQLVESGGGLVQPKGSLKLSCAASGFTFNTYAMNWVRQAPGKGLEWVARIRSKSNNYATYYADSVKDRFTISRDDSQSMLYLQMNNLKTEDTAMYYCVRQWDYDVRAMNYWGQGTSVTVSSGGGGSGGGGSGGGGSDIVMTQSHIFMSTSVGDRVSITCKASQDVDTAVAWYQQKPGQSPKLLIYWASTRLTGVPDRFTGSGSGTDFTLTISNVQSEDLADYFCQQYSSYPYTFGGGTKLEIKEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2525 - protein, 468 aa, Artificial Sequence
  source: /note="Description of Artificial Sequence: Synthetic Chimeric Antigen Receptor sequence"
QVTLKESGPGILKPSQTLSLTCSFSGFSLSTSGMGVGWIRQPSGKGLEWLAHIWWDDDKYYNPSLKSQLTISKDTSRNQVFLKITSVDTADTATYYCSRRPRGTMDAMDYWGQGTSVTVSSGGGGSGGGGSGGGGSDIVMTQAASSLSASLGDRVTISCRASQDISKYLNWYQQKPDGTVKLLIYYTSRLHSGVPSRFSGSGSGTDYSLTIRNLEQEDIATYFCQQVYTLPWTFGGGTKLEIKSGTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2526 - protein, 470 aa, Artificial Sequence
  source: /note="Description of Artificial Sequence: Synthetic Chimeric Antigen Receptor sequence"
QVTLKESGPGILKPSQTLSLTCSFSGFSLNTSGMGVGWIRQPSGKGLEWLAHIWWDDDKYYNPSLKSQLTISKDTSRNQVFLKITSVDTADSATYYCARRASHVSTVDSFDFWGQGTTLTVSSGGGGSGGGGSGGGGSDIQMTQTTSSLSASLGDRVTISCRASQDISNYLNWFQQKPDGTVKLLIYYTSRLHSGVPSKFSGSGSGTDYSLTISNLEQEDIATYFCQQGYTLPWTFGGGTKLEIKSGTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2527 - protein, 491 aa, Artificial Sequence
  source: /note="Description of Artificial Sequence: Synthetic Chimeric Antigen Receptor sequence"
MALPVTALLLPLALLLHAARPQVTLKESGPGILKPSQTLSLTCSFSGFSLNTSGMGVGWIRQPSGKGLEWLAHIWWDDDKYYNPSLKSQLTISKDTSRNQVFLKITSVDTADSATYYCARRASHVSTVDSFDFWGQGTTLTVSSGGGGSGGGGSGGGGSDIQMTQTTSSLSASLGDRVTISCRASQDISNYLNWFQQKPDGTVKLLIYYTSRLHSGVPSKFSGSGSGTDYSLTISNLEQEDIATYFCQQGYTLPWTFGGGTKLEIKSGTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2528 - protein, 546 aa, Artificial Sequence
  source: /note="Description of Artificial Sequence: Synthetic Chimeric Antigen Receptor sequence"
MDFQVQIFSFLLISASVIMSRGDIQMTQSPSSVSASIGDRVTITCRASQGIDNWLGWYQQKPGKAPKLLIYDASNLDTGVPSRFSGSGSGTYFTLTISSLQAEDFAVYFCQQAKAFPPTFGGGTKVDIKGSTSGSGKPGSGEGSEVQLVQSGGGLVKPGGSLRLSCAASGFTFSSYSMNWVRQAPGKGLEWVSSISSSSSYIYYADSVKGRFTISRDNAKNSLYLQMNSLRAEDTAVYYCARVTDAFDIWGQGTMVTVSSAAAFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2529 - protein, 709 aa, Artificial Sequence
  source: /note="Description of Artificial Sequence: Synthetic Chimeric Antigen Receptor sequence"
QVTLKESGPGILKPSQTLSLTCSFSGFSLSTSGMGVGWIRQPSGKGLEWLAHIWWDDDKYYNPSLKSQLTISKDTSRNQVFLKITSVDTADTATYYCSRRPRGTMDAMDYWGQGTSVTVSSGGGGSGGGGSGGGGSDIVMTQAASSLSASLGDRVTISCRASQDISKYLNWYQQKPDGTVKLLIYYTSRLHSGVPSRFSGSGSGTDYSLTIRNLEQEDIATYFCQQVYTLPWTFGGGTKLEIKLEDPAEPKSPDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKKDPKSGTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2530 - protein, 711 aa, Artificial Sequence
  source: /note="Description of Artificial Sequence: Synthetic Chimeric Antigen Receptor sequence"
QVTLKESGPGILKPSQTLSLTCSFSGFSLNTSGMGVGWIRQPSGKGLEWLAHIWWDDDKYYNPSLKSQLTISKDTSRNQVFLKITSVDTADSATYYCARRASHVSTVDSFDFWGQGTTLTVSSGGGGSGGGGSGGGGSDIQMTQTTSSLSASLGDRVTISCRASQDISNYLNWFQQKPDGTVKLLIYYTSRLHSGVPSKFSGSGSGTDYSLTISNLEQEDIATYFCQQGYTLPWTFGGGTKLEIKLEDPAEPKSPDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKKDPKSGTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2531 - protein, 730 aa, Artificial Sequence
  source: /note="Description of Artificial Sequence: Synthetic Chimeric Antigen Receptor sequence"
MALPVTALLLPLALLLHAARPQVTLKESGPGILKPSQTLSLTCSFSGFSLSTSGMGVGWIRQPSGKGLEWLAHIWWDDDKYYNPSLKSQLTISKDTSRNQVFLKITSVDTADTATYYCSRRPRGTMDAMDYWGQGTSVTVSSGGGGSGGGGSGGGGSDIVMTQAASSLSASLGDRVTISCRASQDISKYLNWYQQKPDGTVKLLIYYTSRLHSGVPSRFSGSGSGTDYSLTIRNLEQEDIATYFCQQVYTLPWTFGGGTKLEIKLEDPAEPKSPDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKKDPKSGTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2532 - protein, 732 aa, Artificial Sequence
  source: /note="Description of Artificial Sequence: Synthetic Chimeric Antigen Receptor sequence"
MALPVTALLLPLALLLHAARPQVTLKESGPGILKPSQTLSLTCSFSGFSLNTSGMGVGWIRQPSGKGLEWLAHIWWDDDKYYNPSLKSQLTISKDTSRNQVFLKITSVDTADSATYYCARRASHVSTVDSFDFWGQGTTLTVSSGGGGSGGGGSGGGGSDIQMTQTTSSLSASLGDRVTISCRASQDISNYLNWFQQKPDGTVKLLIYYTSRLHSGVPSKFSGSGSGTDYSLTISNLEQEDIATYFCQQGYTLPWTFGGGTKLEIKLEDPAEPKSPDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKKDPKSGTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2533 - protein, 726 aa, Artificial Sequence
  source: /note="Description of Artificial Sequence: Synthetic Chimeric Antigen Receptor sequence"
LLVTSLLLCELPHPAFLLIPDTDVKLQESGPGLVAPSQSLSITCTVSGFSLTSYAVSWVRQPPGKGLEWLGIIWSGGATNYNSALKSRLSISKDNSKSQVFLKMNGLQTDDTARYYCAREHYYGSSAMDYWGQGASITVSSGGGGSGGGGSGGGGSGIVMTQSPLSLPVSLGDQASISCRSSQSIVHSYGNTYLFWYLQKPGQSPKLLIYRVSNRFSGVPDRFSGSGSGTNFTLKISRVEAEDMGVYYCFQGTHVPYTFGGGTKLEIKEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKKDPKAAAIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2534 - protein, 481 aa, Artificial Sequence
  source: /note="Description of Artificial Sequence: Synthetic Chimeric Antigen Receptor sequence"
MDFQVQIFSFLLISASVIMSRGDIQMTQSPSSVSASIGDRVTITCRASQGIDNWLGWYQQKPGKAPKLLIYDASNLDTGVPSRFSGSGSGTYFTLTISSLQAEDFAVYFCQQAKAFPPTFGGGTKVDIKGSTSGSGKPGSGEGSEVQLVQSGGGLVKPGGSLRLSCAASGFTFSSYSMNWVRQAPGKGLEWVSSISSSSSYIYYADSVKGRFTISRDNAKNSLYLQMNSLRAEDTAVYYCARVTDAFDIWGQGTMVTVSSAAAIEVMYPPPYLDNEKSNGTIIHVKGKHLCPSPLFPGPSKPFWVLVVVGGVLACYSLLVTVAFIIFWRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2535 - protein, 487 aa, Artificial Sequence
  source: /note="Description of Artificial Sequence: Synthetic Chimeric Antigen Receptor sequence"
MGWSCIILFLVATATGVHSEVQLVETGGGLVQPGNSLKLSCATSGFIFSTTWMNWIRQTPGKRLEWLAQIEDKSNNYFISYSESVKGRFTISRDDSKSSVYLQMNNLKEEDTAIYYCSWKYRSNYYFDYWGQGVMVTVSSGSTSGSGKPGSGEGSDIVLTQSPALAVSLEQRATISCKTSQNVDYYGISYLHWYQQKPGQQPKLLIYEGSNLASGIPARFSGSGSGTDFTLTIDPVEADDIVTYYCQQSKDYPYTFGAGTKLELKAAAIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2536 - protein, 494 aa, Artificial Sequence
  source: /note="Description of Artificial Sequence: Synthetic Chimeric Antigen Receptor sequence"
MGWSCIILFLVATATGVHSEVQLVETGGGLVQPGNSLKLSCATSGFIFSTTWMNWIRQTPGKRLEWLAQIEDKSNNYFISYSESVKGRFTISRDDSKSSVYLQMNNLKEEDTAIYYCSWKYRSNYYFDYWGQGVMVTVSSGSTSGSGKPGSGEGSDIVLTQSPALAVSLEQRATISCKTSQNVDYYGISYLHWYQQKPGQQPKLLIYEGSNLASGIPARFSGSGSGTDFTLTIDPVEADDIVTYYCQQSKDYPYTFGAGTKLELKAAATTTKPVLRTPSPVHPTGTSQPQRPEDCRPRGSVKGTGLDFACDIYIWAPLAGICVALLLSLIITLICYHRSRNSRRNRLLQVTTMNMTPRRPGLTRKPYQPYAPARDFAAYRPRAKFSRSAETAANLQDPNQLYNELNLGRREEYDVLEKKRARDPEMGGKQQRRRNPQEGVYNALQKDKMAEAYSEIGTKGERRRGKGHDGLYQGLSTATKDTYDALHMQTLAPR

SEQ ID NO: 2537 - protein, 539 aa, Artificial Sequence
  source: /note="Description of Artificial Sequence: Synthetic Chimeric Antigen Receptor sequence"
MGWSCIILFLVATATGVHSEVQLVETGGGLVQPGNSLKLSCATSGFIFSTTWMNWIRQTPGKRLEWLAQIEDKSNNYFISYSESVKGRFTISRDDSKSSVYLQMNNLKEEDTAIYYCSWKYRSNYYFDYWGQGVMVTVSSGSTSGSGKPGSGEGSDIVLTQSPALAVSLEQRATISCKTSQNVDYYGISYLHWYQQKPGQQPKLLIYEGSNLASGIPARFSGSGSGTDFTLTIDPVEADDIVTYYCQQSKDYPYTFGAGTKLELKAAATTTKPVLRTPSPVHPTGTSQPQRPEDCRPRGSVKGTGLDFACDIYIWAPLAGICVALLLSLIITLICYHRSRNSRRNRLLQVTTMNMTPRRPGLTRKPYQPYAPARDFAAYRPKWIRKKFPHIFKQPFKKTTGAAQEEDACSCRCPQEEEGGGGGYELRAKFSRSAETAANLQDPNQLYNELNLGRREEYDVLEKKRARDPEMGGKQQRRRNPQEGVYNALQKDKMAEAYSEIGTKGERRRGKGHDGLYQGLSTATKDTYDALHMQTLAPR

SEQ ID NO: 2538 - protein, 551 aa, Artificial Sequence
  source: /note="Description of Artificial Sequence: Synthetic Chimeric Antigen Receptor sequence"
MGWSCIILFLVATATGVHSEVQLVETGGGLVQPGNSLKLSCATSGFIFSTTWMNWIRQTPGKRLEWLAQIEDKSNNYFISYSESVKGRFTISRDDSKSSVYLQMNNLKEEDTAIYYCSWKYRSNYYFDYWGQGVMVTVSSGSTSGSGKPGSGEGSDIVLTQSPALAVSLEQRATISCKTSQNVDYYGISYLHWYQQKPGQQPKLLIYEGSNLASGIPARFSGSGSGTDFTLTIDPVEADDIVTYYCQQSKDYPYTFGAGTKLELKAAAFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2539 - protein, 708 aa, Artificial Sequence [sequence omitted]

SEQ ID NO: 2540 - protein, 33 aa, Homo sapiens
MGLHLRPYRVGLLPDGLLFLLLLLMLLADPALP

SEQ ID NO: 2541 - protein, 24 aa, Homo sapiens
MSAPKLLSLGCIFFPLLLFQQARA

SEQ ID NO: 2542 - protein, 26 aa, Homo sapiens
MCPRAARAPATLLLALGAVLWPAAGA

SEQ ID NO: 2543 - protein, 18 aa, Homo sapiens
MKLSLVAAMLLLLSAARA

SEQ ID NO: 2544 - protein, 20 aa, Homo sapiens
MEPWPLLLLFSLCSAGLVLG

SEQ ID NO: 2545 - protein, 23 aa, Homo sapiens
MTPGALLMLLGALGAPLAPGVRG

SEQ ID NO: 2546 - protein, 20 aa, Homo sapiens
MARAPLGVLLLLGLLGRGVG

SEQ ID NO: 2547 - protein, 19 aa, Homo sapiens
MVEMLPTAILLVLAVSVVA

SEQ ID NO: 2548 - protein, 16 aa, Homo sapiens
MFRLWLLLAGLCGLLA

SEQ ID NO: 2549 - protein, 28 aa, Homo sapiens
MECCRRATPGTLLLFLAFLLLSSRTARS

SEQ ID NO: 2550 - protein, 18 aa, Homo sapiens
MLLLGAVLLLLALPGHDQ

SEQ ID NO: 2551 - protein, 21 aa, Artificial Sequence
  source: /note="Description of Artificial Sequence: Synthetic Signal Sequence"
MKLVSVALMYLGSLAFLGADT

SEQ ID NO: 2552 - protein, 16 aa, Homo sapiens
MTTLLWVFVTLRVITA

SEQ ID NO: 2553 - protein, 17 aa, Homo sapiens
MISPFLVLAIGTCLTNS

SEQ ID NO: 2554 - protein, 18 aa, Homo sapiens
MALSWVLTVLSLLPLLEA

SEQ ID NO: 2555 - protein, 23 aa, Homo sapiens
MERMLPLLALGLLAAGFCPAVLC

SEQ ID NO: 2556 - protein, 24 aa, Homo sapiens
MPSSVSWGILLLAGLCCLVPVSLA

SEQ ID NO: 2557 - protein, 21 aa, Homo sapiens
MSMLVVFLLLWGVTWGPVTEA

SEQ ID NO: 2558 - protein, 27 aa, Homo sapiens
MALLWGLLVLSWSCLQGPCSVFSPVSA

SEQ ID NO: 2559 - protein, 18 aa, Artificial Sequence
  source: /note="Description of Artificial Sequence: Synthetic Signal Sequence"
MKSLVLLLCLAQLWGCHS

SEQ ID NO: 2560 - protein, 23 aa, Homo sapiens
MGKNKLLHPSLVLLLLVLLPTDA

SEQ ID NO: 2561 - protein, 15 aa, Homo sapiens
MKFFLLLFTIGFCWA

SEQ ID NO: 2562 - protein, 18 aa, Homo sapiens
MKWVESIFLIFLLNFTES

SEQ ID NO: 2563 - protein, 31 aa, Homo sapiens
MQLRNPELHLGCALALRFLALVSWDIPGARA

SEQ ID NO: 2564 - protein, 19 aa, Homo sapiens
MRFFVPLFLVGILFPAILA

SEQ ID NO: 2565 - protein, 17 aa, Homo sapiens
MLLKTVLLLGHVAQVLM

SEQ ID NO: 2566 - protein, 23 aa, Homo sapiens
MEAVAVAAAVGVLLLAGAGGAAG

SEQ ID NO: 2567 - protein, 15 aa, Homo sapiens
MRLLILTCLVAVALA

SEQ ID NO: 2568 - protein, 23 aa, Homo sapiens
MGTSHPAFLVLGCLLTGLSLILC

SEQ ID NO: 2569 - protein, 16 aa, Homo sapiens
MGTWILFACLLGAAFA

SEQ ID NO: 2570 - protein, 16 aa, Homo sapiens
MRSTILLFCLLGSTRS

SEQ ID NO: 2571 - protein, 19 aa, Homo sapiens
MPALGWAVAAILMLQTAMA

SEQ ID NO: 2572 - protein, 17 aa, Homo sapiens
MLPGLALLLLAAWTARA

SEQ ID NO: 2573 - protein, 24 aa, Homo sapiens
MVMGLGVLLLVFVLGLGLTPPTLA

SEQ ID NO: 2574 - protein, 22 aa, Homo sapiens
MDSLASLVLCGVSLLLSGTVEG

SEQ ID NO: 2575 - protein, 16 aa, Homo sapiens
MFTIKLLLFIVPLVIS

SEQ ID NO: 2576 - protein, 26 aa, Homo sapiens
MLKKPLSAVTWLCIFIVAFVSHPAWL

SEQ ID NO: 2577 - protein, 31 aa, Homo sapiens
MGQGWATAGLPSLLFLLLCYGHPLLVPSQEA

SEQ ID NO: 2578 - protein, 33 aa, Homo sapiens
MRKRAPQSEMAPAGVSLRATILCLLAWAGLAAG

SEQ ID NO: 2579 - protein, 20 aa, Homo sapiens
MEKIPVSAFLLLVALSYTLA

SEQ ID NO: 2580 - protein, 21 aa, Homo sapiens
MMLHSALGLCLLLVTVSSNLA

SEQ ID NO: 2581 - protein, 25 aa, Artificial Sequence
  source: /note="Description of Artificial Sequence: Synthetic Signal Sequence"
MKSSGLFPFLVLLALGTLAPWAVEG

SEQ ID NO: 2582 - protein, 32 aa, Artificial Sequence
  source: /note="Description of Artificial Sequence: Synthetic polypeptide"
MYSNVIGTVTSGKRKVYLLSLLLIGFWDCVTC

SEQ ID NO: 2583 - protein, 18 aa, Homo sapiens
MKAAVLTLAVLFLTGSQA

SEQ ID NO: 2584 - protein, 18 aa, Homo sapiens
MKLLAATVLLLTICSLEG

SEQ ID NO: 2585 - protein, 20 aa, Homo sapiens
MFLKAVVLTLALVAVAGARA

SEQ ID NO: 2586 - protein, 27 aa, Homo sapiens
MDPPRPALLALLALPALLLLLLAGARA

SEQ ID NO: 2587 - protein, 22 aa, Homo sapiens
MGTRLLPALFLVLLVLGFEVQG

SEQ ID NO: 2588 - protein, 20 aa, Homo sapiens
MQPRVLLVVALLALLASARA

SEQ ID NO: 2589 - protein, 26 aa, Homo sapiens
MRLFLSLPVLVVVLSIVLEGPAPAQG

SEQ ID NO: 2590 - protein, 20 aa, Homo sapiens
MVMLLLLLSALAGLFGAAEG

SEQ ID NO: 2591 - protein, 18 aa, Homo sapiens
MKVLWAALLVTFLAGCQA

SEQ ID NO: 2592 - protein, 22 aa, Homo sapiens
MFHQIWAALLYFYGIILNSIYQ

SEQ ID NO: 2593 - protein, 19 aa, Homo sapiens
MEHKEVVLLLLLFLKSAAP

SEQ ID NO: 2594 - protein, 30 aa, Homo sapiens
MAPHGPGSLTTLVPWAAALLLALGVERALA

SEQ ID NO: 2595 - protein, 23 aa, Homo sapiens
MPSPGTVCSLLLLGMLWLDLAMA

SEQ ID NO: 2596 - protein, 18 aa, Homo sapiens
MGAPRSLLLALAAGLAVA

SEQ ID NO: 2597 - protein, 25 aa, Homo sapiens
MSSFSTTTVSFLLLLAFQLLGQTRA

SEQ ID NO: 2598 - protein, 32 aa, Homo sapiens
MPGPRRPAGSRLRLLLLLLLPPLLLLLRGSHA

SEQ ID NO: 2599 - protein, 26 aa, Homo sapiens
MTRLTVLALLAGLLASSRAGSSPLLD

SEQ ID NO: 2600 - protein, 31 aa, Homo sapiens
MRENMARGPCNAPRWVSLMVLVAIGTAVTAA

SEQ ID NO: 2601 - protein, 20 aa, Homo sapiens
MAWASRLGLLLALLLPVVGA

SEQ ID NO: 2602 - protein, 16 aa, Homo sapiens
MLLILLSVALLALSSA

SEQ ID NO: 2603 - protein, 21 aa, Homo sapiens
MAAALFVLLGFALLGTHGASG

SEQ ID NO: 2604 - protein, 32 aa, Homo sapiens
MPGGPGVLQALPATIFLLFLLSAVYLGPGCQA

SEQ ID NO: 2605 - protein, 28 aa, Homo sapiens
MARLALSPVPSHWMVALLLLLSAEPVPA

SEQ ID NO: 2606 - protein, 31 aa, Homo sapiens
MSSWIRWHGPAMARLWGFCWLVVGFWRAAFA

SEQ ID NO: 2607 - protein, 19 aa, Homo sapiens
MISPVLILFSSFLCHVAIA

SEQ ID NO: 2608 - protein, 20 aa, Homo sapiens
MSRSVALAVLALLSLSGLEA

SEQ ID NO: 2609 - protein, 15 aa, Homo sapiens
MKVLILACLVALALA

SEQ ID NO: 2610 - protein, 22 aa, Artificial Sequence
  source: /note="Description of Artificial Sequence: Synthetic peptide"
MRIHYLLFALLFLFLVPVPGHG

SEQ ID NO: 2611 - protein, 20 aa, Homo sapiens
MGLFMIIAILLFQKPTVTEQ

SEQ ID NO: 2612 - protein, 23 aa, Homo sapiens
MPGFLVRILLLLLVLLLLGPTRG

SEQ ID NO: 2613 - protein, 22 aa, Homo sapiens
MARGSAVAWAALGPLLWGCALG

SEQ ID NO: 2614 - protein, 22 aa, Homo sapiens
MTSSRLWFSLLLAAAFAGRATA

SEQ ID NO: 2615 - protein, 20 aa, Homo sapiens
MNVLLGSVVIFATFVTLCNA

SEQ ID NO: 2616 - protein, 20 aa, Homo sapiens
MAWQGLVLAACLLMFPSTTA

SEQ ID NO: 2617 - protein, 32 aa, Homo sapiens
MRLPGAMPALALKGELLLLSLLLLLEPQISQG

SEQ ID NO: 2618 - protein, 20 aa, Homo sapiens
MDRHSSYIFIWLQLELCAMA

SEQ ID NO: 2619 - protein, 16 aa, Homo sapiens
MKLPLLLALLFGAVSA

SEQ ID NO: 2620 - protein, 16 aa, Homo sapiens
MKTALILLSILGMACA

SEQ ID NO: 2621 - protein, 30 aa, Homo sapiens
MLRGTMTAWRGMRPEVTLACLLLATAGCFA

SEQ ID NO: 2622 - protein, 29 aa, Artificial Sequence
  source: /note="Description of Artificial Sequence: Synthetic Signal Sequence"
MKMASSLAFLLLNFHVSLFLVQLLTPCSA

SEQ ID NO: 2623 - protein, 17 aa, Homo sapiens
MALMLSLVLSLLKLGSG

SEQ ID NO: 2624 - protein, 25 aa, Homo sapiens
MAGPAIHTAPMLFLVLLLPLELSLA

SEQ ID NO: 2625 - protein, 48 aa, Homo sapiens
MHPPKTPSGALHRKRKMAAWPFSRLWKVSDPILFQMTLIAALLPAVLG

SEQ ID NO: 2626 - protein, 17 aa, Homo sapiens
MFFWCACCLMVAWRVSA

SEQ ID NO: 2627 - protein, 22 aa, Homo sapiens
MEKKCTLYFLVLLPFFMILVTA

SEQ ID NO: 2628 - protein, 24 aa, Homo sapiens
MRFTFTSRCLALFLLLNHPTPILP

SEQ ID NO: 2629 - protein, 29 aa, Homo sapiens
MEAPGPRALRTALCGGCCCLLLCAQLAVA

SEQ ID NO: 2630 - protein, 28 aa, Homo sapiens
MLRRPAPALAPAARLLLAGLLCGGGVWA

SEQ ID NO: 2631 - protein, 19 aa, Homo sapiens
MDLRQFLMCLSLCTAFALS

SEQ ID NO: 2632 - protein, 18 aa, Homo sapiens
MRMLLALLALSAARPSAS

SEQ ID NO: 2633 - protein, 37 aa, Homo sapiens
MAPLCPSPWLPLLIPAPAPGLTVQLLLSLLLLVPVHP

SEQ ID NO: 2634 - protein, 26 aa, Homo sapiens
MRLHRLRARLSAVACGLLLLLVRGQG

SEQ ID NO: 2635 - protein, 16 aa, Homo sapiens
MRGLLVLSVLLGAVFG

SEQ ID NO: 2636 - protein, 15 aa, Homo sapiens
MLALLVLVTVALASA

SEQ ID NO: 2637 - protein, 17 aa, Homo sapiens
MDFPCLWLGLLLPLVAA

SEQ ID NO: 2638 - protein, 20 aa, Homo sapiens
MSDLLSVFLHLLLLFKLVAP

SEQ ID NO: 2639 - protein, 34 aa, Homo sapiens
MGHLSAPLHRVRVPWQGLLLTASLLTFWNPPTTA

SEQ ID NO: 2640 - protein, 34 aa, Homo sapiens
MGPPSAPPCRLHVPWKEVLLTASLLTFWNPPTTA

SEQ ID NO: 2641 - protein, 35 aa, Homo sapiens
MGSPSACPYRVCIPWQGLLLTASLLTFWNLPNSAQ

SEQ ID NO: 2642 - protein, 34 aa, Homo sapiens
MGPISAPSCRWRIPWQGLLLTASLFTFWNPPTTA

SEQ ID NO: 2643 - protein, 22 aa, Homo sapiens
MRVLSGTSLMLCSLLLLLQALC

SEQ ID NO: 2644 - protein, 18 aa, Homo sapiens
MQPSSLLPLALCLLAAPA

SEQ ID NO: 2645 - protein, 19 aa, Homo sapiens
MKTLLLLLLVLLELGEAQG

SEQ ID NO: 2646 - protein, 18 aa, Homo sapiens
MQPLLLLLAFLLPTGAEA

SEQ ID NO: 2647 - protein, 22 aa, Homo sapiens
MWATLPLLCAGAWLLGVPVCGA

SEQ ID NO: 2648 - protein, 21 aa, Homo sapiens
MALTAHPSCLLALLVAGLAQG

SEQ ID NO: 2649 - protein, 26 aa, Homo sapiens
MFPFYSCWRTGLLLLLLAVAVRESWQ

SEQ ID NO: 2650 - protein, 40 aa, Homo sapiens
MGAAAGRSPHLGPAPARRPQRSLLLLQLLLLVAAPGSTQA

SEQ ID NO: 2651 - protein, 23 aa, Homo sapiens
MQIITTALVCLLLAGMWPEDVDS

SEQ ID NO: 2652 - protein, 16 aa, Homo sapiens
MKVSAVLLCLLLMTAA

SEQ ID NO: 2653 - protein, 19 aa, Homo sapiens
MKISVAAIPFFLLITIALG

SEQ ID NO: 2654 - protein, 21 aa, Homo sapiens
MKVSVAALSCLMLVAVLGSQA

SEQ ID NO: 2655 - protein, 23 aa, Homo sapiens
MKVSEAALSLLVLILIITSASRS

SEQ ID NO: 2656 - protein, 23 aa, Homo sapiens
MAPLKMLALVTLLLGASLQHIHA

SEQ ID NO: 2657 - protein, 20 aa, Homo sapiens
MKGLAAALLVLVCTMALCSC

SEQ ID NO: 2658 - protein, 21 aa, Homo sapiens
MALLLALSLLVLWTSPAPTLS

SEQ ID NO: 2659 - protein, 23 aa, Homo sapiens
MKVSAALLCLLLIAATFIPQGLA

SEQ ID NO: 2660 - protein, 26 aa, Homo sapiens
MCCTKSLLLAALMSVLLLHLCGESEA

SEQ ID NO: 2661 - protein, 23 aa, Homo sapiens
MAQSLALSLLILVLAFGIPRTQG

SEQ ID NO: 2662 - protein, 24 aa, Homo sapiens
MARLQTALLVVLVLLAVALQATEA

SEQ ID NO: 2663 - protein, 21 aa, Homo sapiens
MKVSVAALSCLMLVTALGSQA

SEQ ID NO: 2664 - protein, 26 aa, Homo sapiens
MAGLMTIVTSLLFLGVCAHHIIPTGS

SEQ ID NO: 2665 - protein, 23 aa, Homo sapiens
MMGLSLASAVLLASLLSLHLGTA

SEQ ID NO: 2666 - protein, 24 aa, Homo sapiens
MKGPPTFCSLLLLSLLLSPDPTAA

SEQ ID NO: 2667 - protein, 23 aa, Homo sapiens
MQVSTAALAVLLCTMALCNQFSA

SEQ ID NO: 2668 - protein, 23 aa, Homo sapiens
MQVSTAALAVLLCTMALCNQVLS

SEQ ID NO: 2669 - protein, 23 aa, Homo sapiens
MKLCVTVLSLLMLVAAFCSPALS

SEQ ID NO: 2670 - protein, 23 aa, Homo sapiens
MKVSAAALAVILIATALCAPASA

SEQ ID NO: 2671 - protein, 23 aa, Homo sapiens
MKASAALLCLLLTAAAFSPQGLA

SEQ ID NO: 2672 - protein, 21 aa, Homo sapiens
MQGPPLLTAAHLLCVCTAALA

SEQ ID NO: 2673 - protein, 21 aa, Homo sapiens
MSAVLLLALLGFILPLPGVQA

SEQ ID NO: 2674 - protein, 23 aa, Homo sapiens
MAFDVSCFFWVVLFSAGCKVITS

SEQ ID NO: 2675 - protein, 18 aa, Homo sapiens
MDYPTLLLALLHVYRALC

SEQ ID NO: 2676 - protein, 19 aa, Homo sapiens
MARPHPWWLCVLGTLVGLS

SEQ ID NO: 2677 - protein, 28 aa, Homo sapiens
MLRRRGSPGMGVHVGAALGALWFCLTGA

SEQ ID NO: 2678 - protein, 35 aa, Homo sapiens
MSGGWMAQVGAWRTGALGLALLLLLGLGLGLEAAA

SEQ ID NO: 2679 - protein, 19 aa, Homo sapiens
MALLFSLILAICTRPGFLA

SEQ ID NO: 2680 - protein, 25 aa, Homo sapiens
MGIQGGSVLFGLLLVLAVFCHSGHS

SEQ ID NO: 2681 - protein, 19 aa, Homo sapiens
MSRGLQLLLLSCAYSLAPA

SEQ ID NO: 2682 - protein, 21 aa, Homo sapiens
MALPVTALLLPLALLLHAARP

SEQ ID NO: 2683 - DNA, 63 bp, Homo sapiens
atggccttaccagtgaccgccttgctcctgccgctggccttgctgctccacgccgccaggccg

SEQ ID NO: 2684 - DNA, 63 bp, Homo sapiens
atggcactgcctgtgaccgccctgctgctgccactggccctgctgctgcacgcagccaggccc

SEQ ID NO: 2685 - DNA, 63 bp, Homo sapiens
atggcactgccagtgacagccctgctgctgcctctggccctgctgctgcacgcagccagacct

SEQ ID NO: 2686 - DNA, 63 bp, Homo sapiens
atggcactgcctgtgacagccctgctgctgccactggccctgctgctgcacgcagcccgccct

SEQ ID NO: 2687 - DNA, 63 bp, Homo sapiens
atggcactgcctgtgaccgccctgctgctgccactggccctgctgctgcacgcagcccgccct

SEQ ID NO: 2688 - DNA, 63 bp, Homo sapiens
atggcactgcctgtgaccgccctgctgctgccactggccctgctgctgcacgcagccaggcct

SEQ ID NO: 2689 - DNA, 63 bp, Homo sapiens
atggcactgccagtgaccgccctgctgctgcctctggccctgctgctgcacgcagccagacca

SEQ ID NO: 2690 - DNA, 63 bp, Homo sapiens
atggcactgcctgtgaccgccctgctgctgccactggccctgctgctgcacgcagccaggcca

SEQ ID NO: 2691 - DNA, 63 bp, Homo sapiens
atggcactgcctgtgaccgccctgctgctgccactggccctgctgctgcacgcagccagaccc

SEQ ID NO: 2692 - DNA, 63 bp, Homo sapiens
atggccctgcctgtgacagccctgctgctgcctctggctctgctgctgcatgccgctagaccc

SEQ ID NO: 2693 - DNA, 63 bp, Homo sapiens
atggccctccctgtcaccgccctgctgcttccgctggctcttctgctccacgccgctcggccc

SEQ ID NO: 2694 - protein, 22 aa, Homo sapiens
MARGAALALLLFGLLGVLVAAP

SEQ ID NO: 2695 - protein, 24 aa, Homo sapiens
MGAPAASLLLLLLLFACCWAPGGA

SEQ ID NO: 2696 - protein, 21 aa, Homo sapiens
MVGKMWPVLWTLCAVRVTVDA

SEQ ID NO: 2697 - protein, 23 aa, Homo sapiens
MGLPRLVCAFLLAACCCCPRVAG

SEQ ID NO: 2698 - protein, 28 aa, Homo sapiens
MLCPWRTANLGLLLILTIFLVAASSSLC

SEQ ID NO: 2699 - protein, 17 aa, Homo sapiens
MHLLLFQLLVLLPLGKT

SEQ ID NO: 2700 - protein, 32 aa, Homo sapiens
MLGAKPHWLPGPLHSPGLPLVLVLLALGAGWA

SEQ ID NO: 2701 - protein, 27 aa, Homo sapiens
MGSGRRALSAVPAVLLVLTLPGLPVWA

SEQ ID NO: 2702 - protein, 19 aa, Homo sapiens
MKILILGIFLFLCSTPAWA

SEQ ID NO: 2703 - protein, 21 aa, Homo sapiens
MGVKASQTGFVVLVLLQCCSA

SEQ ID NO: 2704 - protein, 26 aa, Homo sapiens
MGATTMDQKSLWAGVVVLLLLQGGSA

SEQ ID NO: 2705 - protein, 21 aa, Homo sapiens
MVRSVAWAGFMVLLMIPWGSA

SEQ ID NO: 2706 - protein, 20 aa, Homo sapiens
MNSGVCLCVLMAVLAAGALT

SEQ ID NO: 2707 - protein, 17 aa, Homo sapiens
MLAATVLTLALLGNAHA

SEQ ID NO: 2708 - protein, 28 aa, Homo sapiens
MHSKVTIICIRFLFWFLLLCMLIGKSHT

SEQ ID NO: 2709 - protein, 25 aa, Homo sapiens
MVPEVRVLSSLLGLALLWFPLDSHA

SEQ ID NO: 2710 - protein, 20 aa, Homo sapiens
MEMFQGLLLLLLLSMGGTWA

SEQ ID NO: 2711 - protein, 26 aa, Homo sapiens
MAPGSRTSLLLAFALLCLPWLQEAGA

SEQ ID NO: 2712 - protein, 18 aa, Homo sapiens
MRSAAVLALLLCAGQVTA

SEQ ID NO: 2713 - protein, 19 aa, Homo sapiens
MLLLPLPLLLFLLCSRAEA

SEQ ID NO: 2714 - protein, 18 aa, Homo sapiens
MAFLWLLSCWALLGTTFG

SEQ ID NO: 2715 - protein, 22 aa, Homo sapiens
MMKTLLLFVGLLLTWESGQVLG

SEQ ID NO: 2716 - protein, 19 aa, Homo sapiens
MPLLTLYLLLFWLSGYSIA

SEQ ID NO: 2717 - protein, 18 aa, Homo sapiens
MRLLVLLWGCLLLPGYEA

SEQ ID NO: 2718 - protein, 28 aa, Homo sapiens
MFPGCPRLWVLVVLGTSWVGWGSQGTEA

SEQ ID NO: 2719 - protein, 19 aa, Homo sapiens
MQIELSTCFFLCLLRFCFS

SEQ ID NO: 2720 - protein, 18 aa, Homo sapiens
MIFLYQVVHFILFTSVSG

SEQ ID NO: 2721 - protein, 19 aa, Homo sapiens
MRALLLLGFLLVSLESTLS

SEQ ID NO: 2722 - protein, 20 aa, Homo sapiens
MRLKNLTFIIILIISGELYA

SEQ ID NO: 2723 - protein, 27 aa, Homo sapiens
MESSRVRLLPLLGAALLLMLPLLGTRA

SEQ ID NO: 2724 - protein, 17 aa, Homo sapiens
MEKILILLLVALSVAYA

SEQ ID NO: 2725 - protein, 21 aa, Homo sapiens
MAAALALVAGVLSGAVLPLWS

SEQ ID NO: 2726 - protein, 22 aa, Homo sapiens
MFSFVDLRLLLLLAATALLTHG

SEQ ID NO: 2727 - protein, 23 aa, Homo sapiens
MMSFVQKGSWLLLALLHPTIILA

SEQ ID NO: 2728 - protein, 27 aa, Homo sapiens
MGPRLSVWLLLLPAALLLHEEHSRAAA

SEQ ID NO: 2729 - protein, 23 aa, Homo sapiens
MKTCWKIPVFFFVCSFLEPWASA

SEQ ID NO: 2730 - protein, 19 aa, Homo sapiens
MRAARALLPLLLQACWTAA

SEQ ID NO: 2731 - protein, 21 aa, Homo sapiens
MWVSWAPGLWLLGLWATFGHG

SEQ ID NO: 2732 - protein, 25 aa, Homo sapiens
MGRDQRAVAGPALRRWLLLGTVTVG

SEQ ID NO: 2733 - protein, 26 aa, Homo sapiens
MMANWAEARPLLILIVLLGQFVSIKA

SEQ ID NO: 2734 - protein, 30 aa, Homo sapiens
MRPQGPAASPQRLRGLLLLLLLQLPAPSSA

SEQ ID NO: 2735 - protein, 22 aa, Homo sapiens
MEGPRGWLVLCVLAISLASMVT

SEQ ID NO: 2736 - protein, 25 aa, Homo sapiens
MKIPWGSIPVLMLLLLLGLIDISQA

SEQ ID NO: 2737 - protein, 28 aa, Homo sapiens
MDVGPSSLPHLGLKLLLLLLLLPLRGQA

SEQ ID NO: 2738 - protein, 15 aa, Homo sapiens
MRPLLVLLLLGLAAG

SEQ ID NO: 2739 - protein, 27 aa, Homo sapiens
MVTAALGPVWAALLLFLLMCEIPMVEL

SEQ ID NO: 2740 - protein, 17 aa, Homo sapiens
MWLLYLLVPALFCRAGG

SEQ ID NO: 2741 - protein, 15 aa, Homo sapiens
MWCIVLFSLLAWVYA

SEQ ID NO: 2742 - protein, 20 aa, Homo sapiens
MGPLMVLFCLLFLYPGLADS

SEQ ID NO: 2743 - protein, 22 aa, Homo sapiens
MGPTSGPSLLLLLLTHLPLALG

SEQ ID NO: 2744 - protein, 19 aa, Homo sapiens
MRLLWGLIWASSFFTLSLQ

SEQ ID NO: 2745 - protein, 21 aa, Homo sapiens
MATSMGLLLLLLLLLTQPGAG

SEQ ID NO: 2746 - protein, 21 aa, Homo sapiens
MARRSVLYFILLNALINKGQA

SEQ ID NO: 2747 - protein, 22 aa, Homo sapiens
MKVISLFILVGFIGEFQSFSSA

SEQ ID NO: 2748 - protein, 20 aa, Homo sapiens
MLPPGTATLLTLLLAAGSLG

SEQ ID NO: 2749 - protein, 21 aa, Homo sapiens
MSACRSFAVAICILEISILTA

SEQ ID NO: 2750 - protein, 34 aa, Homo sapiens
MTVARPSVPAALPLLGELPRLLLLVLLCLPAVWG

SEQ ID NO: 2751 - protein, 25 aa, Homo sapiens
MGSNLSPQLCLMPFILGLLSGGVTT

SEQ ID NO: 2752 - protein, 17 aa, Artificial Sequence
  source: /note="Description of Artificial Sequence: Synthetic peptide"
RLLAKIICLMLWAICVA

SEQ ID NO: 2753 - protein, 18 aa, Homo sapiens
MWLLVSVILISRISSVGG

SEQ ID NO: 2754 - protein, 18 aa, Homo sapiens
MKLLHVFLLFLCFHLRFC

SEQ ID NO: 2755 - protein, 41 aa, Homo sapiens
MGASSPRSPEPVGPPAPGLPFCCGGSLLAVVVLLALPVAWG

SEQ ID NO: 2756 - protein, 20 aa, Homo sapiens
MGAAGLLGVFLALVAPGVLG

SEQ ID NO: 2757 - protein, 20 aa, Artificial Sequence
  source: /note="Description of Artificial Sequence: Synthetic Signal Sequence"
MKMWLLVSHLVIISITTCLA

SEQ ID NO: 2758 - protein, 30 aa, Homo sapiens
MGTATRRKPHLLLVAAVALVSSSAWSSALG

SEQ ID NO: 2759 - protein, 22 aa, Homo sapiens
MPLLLYTCLLWLPTSGLWTVQA

SEQ ID NO: 2760 - protein, 26 aa, Homo sapiens
MPRSCCSRSGALLLALLLQASMEVRG

SEQ ID NO: 2761 - protein, 23 aa, Homo sapiens
MGGHPQLRLVKALLLLGLNPVSA

SEQ ID NO: 2762 - protein, 24 aa, Homo sapiens
MSPNFKLQCHFILIFLTALRGESR

SEQ ID NO: 2763 - protein, 18 aa, Homo sapiens
MEKLLCFLVLTSLSHAFG

SEQ ID NO: 2764 - protein, 21 aa, Homo sapiens
MRLSVCLLLLTLALCCYRANA

SEQ ID NO: 2765 - protein, 20 aa, Homo sapiens
MKLAALLGLCVALSCSSAAA

SEQ ID NO: 2766 - protein, 21 aa, Homo sapiens
MQAAWLLGALVVPQLLGFGHG

SEQ ID NO: 2767 - protein, 21 aa, Homo sapiens
MRPAFALCLLWQALWPGPGGG

SEQ ID NO: 2768 - protein, 29 aa, Homo sapiens
MAGLNCGVSIALLGVLLLGAARLPRGAEA

SEQ ID NO: 2769 - protein, 21 aa, Homo sapiens
MNQTAILICCLIFLTLSGIQG

SEQ ID NO: 2770 - protein, 21 aa, Artificial Sequence
  source: /note="Description of Artificial Sequence: Synthetic Signal Sequence"
MSVKGMAIALAVILCATVVQG

SEQ ID NO: 2771 - protein, 34 aa, Homo sapiens
MARATLSAAPSNPRLLRVALLLLLLVAASRRAAG

SEQ ID NO: 2772 - protein, 34 aa, Homo sapiens
MAHATLSAAPSNPRLLRVALLLLLLVAASRRAAG

SEQ ID NO: 2773 - protein, 36 aa, Homo sapiens
MSLLSSRAARVPGPSSSLCALLVLLLLLTQPGPIAS

SEQ ID NO: 2774 - protein, 37 aa, Homo sapiens
MSLPSSRAARVPGPSGSLCALLALLLLLTPPGPLASA

SEQ ID NO: 2775 - protein, 22 aa, Homo sapiens
MKKSGVLFLLGIILLVLIGVQG

SEQ ID NO: 2776 - protein, 28 aa, Homo sapiens
MSSPQRRKAMPWALSLLLMGFQLLVTYA

SEQ ID NO: 2777 - protein, 28 aa, Homo sapiens
MLGLPWKGGLSWALLLLLLGSQILLIYA

SEQ ID NO: 2778 - protein, 26 aa, Homo sapiens
MAGPLRAPLLLLAILAVALAVSPAAG

SEQ ID NO: 2779 - protein, 20 aa, Homo sapiens
MMWPMHTPLLLLTALMVAVA

SEQ ID NO: 2780 - protein, 20 aa, Homo sapiens
MARPLCTLLLLMATLAGALA

SEQ ID NO: 2781 - protein, 20 aa, Homo sapiens
MAWPLCTLLLLLATQAVALA

SEQ ID NO: 2782 - protein, 20 aa, Homo sapiens
MAQHLSTLLLLLATLAVALA

SEQ ID NO: 2783 - protein, 34 aa, Homo sapiens
MYLVAGDRGLAGCGHLLVSLLGLLLLLARSGTRA

SEQ ID NO: 2784 - protein, 21 aa, Homo sapiens
MEIKHLLFLVAAACLLPMLSM

SEQ ID NO: 2785 - protein, 24 aa, Homo sapiens
MRLPRRAALGLLPLLLLLPPAPEA

SEQ ID NO: 2786 - protein, 22 aa, Homo sapiens
MLKPSLPFTSLLFLQLPLLGVG

SEQ ID NO: 2787 - protein, 37 aa, Homo sapiens
MPAGRRGPAAQSARRPPPLLPLLLLLCVLGAPRAGSG

SEQ ID NO: 2788 - protein, 21 aa, Homo sapiens
MRLLILALLGICSLTAYIVEG

SEQ ID NO: 2789 - protein, 22 aa, Homo sapiens
MRTPGPLPVLLLLLAGAPAARP

SEQ ID NO: 2790 - protein, 23 aa, Homo sapiens
MTATEALLRVLLLLLAFGHSTYG

SEQ ID NO: 2791 - protein, 26 aa, Homo sapiens
MAAASRSASGWALLLLVALWQQRAAG

SEQ ID NO: 2792 - protein, 22 aa, Homo sapiens
MRGMKLLGALLALAALLQGAVS

SEQ ID NO: 2793 - protein, 19 aa, Homo sapiens
MRFMTLLFLTALAGALVCA

SEQ ID NO: 2794 - protein, 21 aa, Homo sapiens
MKFQGPLACLLLALCLGSGEA

SEQ ID NO: 2795 - protein, 31 aa, Homo sapiens
MMALGAAGATRVFVAMVAAALGGHPLLGVSA

SEQ ID NO: 2796 - protein, 21 aa, Homo sapiens
MQRLGATLLCLLLAAAVPTAP

SEQ ID NO: 2797 - protein, 18 aa, Homo sapiens
MVAAVLLGLSWLCSPLGA

SEQ ID NO: 2798 - protein, 16 aa, Homo sapiens
MWSGWWLWPLVAVCTA

SEQ ID NO: 2799 - protein, 24 aa, Homo sapiens
MGAGPSLLLAALLLLLSGDGAVRC

SEQ ID NO: 2800 - protein, 22 aa, Homo sapiens
MAPPGSSTVFLLALTIIASTWA

SEQ ID NO: 2801 - protein, 23 aa, Homo sapiens
MEAPAAGLFLLLLLGTWAPAPGS

SEQ ID NO: 2802 - protein, 25 aa, Homo sapiens
MASLFRSYLPAIWLLLSQLLRESLA

SEQ ID NO: 2803 - protein, 21 aa, Homo sapiens
MRGLAVLLTVALATLLAPGAG

SEQ ID NO: 2804 - protein, 25 aa, Homo sapiens
MGSRAELCTLLGGFSFLLLLIPGEG

SEQ ID NO: 2805 - protein, 22 aa, Homo sapiens
MRASSFLIVVVFLIAGTLVLEA

SEQ ID NO: 2806 - protein, 16 aa, Homo sapiens
MIRTLLLSTLVAGALS

SEQ ID NO: 2807 - protein, 25 aa, Homo sapiens
MDRGTLPLAVALLLASCSLSPTSLA

SEQ ID NO: 2808 - protein, 32 aa, Homo sapiens
MAAAVPRAAFLSPLLPLLLGFLLLSAPHGGSG

SEQ ID NO: 2809 - protein, 21 aa, Homo sapiens
MRALWVLGLCCVLLTFGSVRA

SEQ ID NO: 2810 - protein, 29 aa, Homo sapiens
MISLPGPLVTNLLRFLFLGLSALAPPSRA

SEQ ID NO: 2811 - protein, 17 aa, Homo sapiens
MDYLLMIFSLLFVACQG

SEQ ID NO: 2812 - protein, 27 aa, Homo sapiens
MVPKLFTSQICLLLLLGLMGVEGSLHA

SEQ ID NO: 2813 - protein, 23 aa, Homo sapiens
MKVSAALLWLLLIAAAFSPQGLA

SEQ ID NO: 2814 - protein, 20 aa, Homo sapiens
MDCQLSILLLLSCSVLDSFG

SEQ ID NO: 2815 - protein, 17 aa, Homo sapiens
MALDYLLLLLLASAVAA

SEQ ID NO: 2816 - protein, 16 aa, Homo sapiens
MVCSLWVLLLVSSVLA

SEQ ID NO: 2817 - protein, 18 aa, Homo sapiens
MEFLWAPLLGLCCSLAAA

SEQ ID NO: 2818 - protein, 25 aa, Homo sapiens
MRLLPLLRTVLWAAFLGSPLRGGSS

SEQ ID NO: 2819 - protein, 27 aa, Homo sapiens
MARPGQRWLGKWLVAMVVWALCRLATP

SEQ ID NO: 2820 - protein, 27 aa, Homo sapiens
MGPPHSGPGGVRVGALLLLGVLGLVSG

SEQ ID NO: 2821 - protein, 24 aa, Homo sapiens
MRPSGTAGAALLALLAALCPASRA

SEQ ID NO: 2822 - protein, 22 aa, Homo sapiens
MALGVPISVYLLFNAMTALTEE

SEQ ID NO: 2823 - protein, 23 aa, Homo sapiens
MGRGWGFLFGLLGAVWLLSSGHG

SEQ ID NO: 2824 - protein, 27 aa, Homo sapiens
MGVHECPAWLWLLLSLLSLPLGLPVLG

SEQ ID NO: 2825 - protein, 24 aa, Homo sapiens
MDHLGASLWPQVGSLCLLLAGAAW

SEQ ID NO: 2826 - protein, 21 aa, Homo sapiens
MIASQFLSALTLVLLIKESGA

SEQ ID NO: 2827 - protein, 18 aa, Homo sapiens
MLALLCSCLLLAAGASDA

SEQ ID NO: 2828 - protein, 27 aa, Homo sapiens
MKLGCVLMAWALYLSLGVLWVAQMLLA

SEQ ID NO: 2829 - protein, 16 aa, Homo sapiens
MLPRLLLLICAPLCEP

SEQ ID NO: 2830 - protein, 19 aa, Homo sapiens
MLLWSLLVIFDAVTEQADS

SEQ ID NO: 2831 - protein, 19 aa, Homo sapiens
MFSMRIVCLVLSVVGTAWT

SEQ ID NO: 2832 - protein, 30 aa, Homo sapiens
MKRMVSWSFHKLKTMKHLLLLLLCVFLVKS

SEQ ID NO: 2833 - protein, 26 aa, Artificial Sequence
  source: /note="Description of Artificial Sequence: Synthetic Signal Sequence"
MSWSLHPRNLILYFYALLFLSSTCVA

SEQ ID NO: 2834 - protein, 24 aa, Homo sapiens
MRSGCVVVHVWILAGLWLAVAGRP

SEQ ID NO: 2835 - protein, 28 aa, Homo sapiens
MDSDETGFEHSGLWVSVLAGLLLGACQA

SEQ ID NO: 2836 - protein, 24 aa, Homo sapiens
MLGARLRLWVCALCSVCSMSVLRA

SEQ ID NO: 2837 - protein, 22 aa, Homo sapiens
MGAPACALALCVAVAIVAGASS

SEQ ID NO: 2838 - protein, 21 aa, Homo sapiens
MRLLLALLGVLLSVPGPPVLS

SEQ ID NO: 2839 - protein, 24 aa, Homo sapiens
MTPSPLLLLLLPPLLLGAFPPAAA

SEQ ID NO: 2840 - protein, 31 aa, Homo sapiens
MLRGPGPGLLLLAVQCLGTAVPSTGASKSKR

SEQ ID NO: 2841 - protein, 29 aa, Homo sapiens
MERAAPSRRVPLPLLLLGGLALLAAGVDA

SEQ ID NO: 2842 - protein, 29 aa, Homo sapiens
MELSGATMARGLAVLLVLFLHIKNLPAQA

SEQ ID NO: 2843 - protein, 23 aa, Homo sapiens
MDLLWILPSLWLLLLGGPACLKT

SEQ ID NO: 2844 - protein, 19 aa, Homo sapiens
MRLFLWNAVLTLFVTSLIG

SEQ ID NO: 2845 - protein, 21 aa, Homo sapiens
MRLSWFRVLTVLSICLSAVAT

SEQ ID NO: 2846 - protein, 16 aa, Homo sapiens
MVWKWMPLLLLLVCVA

SEQ ID NO: 2847 - protein, 29 aa, Homo sapiens
MVRARHQPGGLCLLLLLLCQFMEDRSAQA

SEQ ID NO: 2848 - protein, 20 aa, Homo sapiens
MWKRWLALALALVAVAWVRA

SEQ ID NO: 2849 - protein, 26 aa, Homo sapiens
MRPGAPGPLWPLPWGALAWAVGFVSS

SEQ ID NO: 2850 - protein, 18 aa, Homo sapiens
MKTLQFFFLFCCWKAICC

SEQ ID NO: 2851 - protein, 24 aa, Homo sapiens
MAPISLSWLLRLATFCHLTVLLAG

SEQ ID NO: 2852 - protein, 22 aa, Homo sapiens
MAMTWIVFSLWPLTVFMGHIGG

SEQ ID NO: 2853 - protein, 26 aa, Artificial Sequence
  source: /note="Description of Artificial Sequence: Synthetic Signal Sequence"
MTAAAGSAGRAAVPLLLCALLAPGGA

SEQ ID NO: 2854 - protein, 18 aa, Homo sapiens
MTPPRLFWVWLLVAGTQG

SEQ ID NO: 2855 - protein, 19 aa, Homo sapiens
MWLLLTMASLISVLGTTHG

SEQ ID NO: 2856 - protein, 16 aa, Homo sapiens
MKWMVVVLVCLQLLEA

SEQ ID NO: 2857 - protein, 21 aa, Homo sapiens
MQRLCVYVLIFALALAAFSEA

SEQ ID NO: 2858 - protein, 23 aa, Homo sapiens
MRGSELPLVLLALVLCLAPRGRA

SEQ ID NO: 2859 - protein, 31 aa, Homo sapiens
MVRPLNPRPLPPVVLMLLLLLPPSPLPLAAG

SEQ ID NO: 2860 - protein, 27 aa, Homo sapiens
MAPHRPAPALLCALSLALCALSLPVRA

SEQ ID NO: 2861 - protein, 19 aa, Homo sapiens
MNWHLPLFLLASVTLPSIC

SEQ ID NO: 2862 - protein, 22 aa, Homo sapiens
MALKNKFSCLWILGLCLVATTS

SEQ ID NO: 2863 - protein, 20 aa, Homo sapiens
MKSIYFVAGLFVMLVQGSWQ

SEQ ID NO: 2864 - protein, 14 aa, Homo sapiens
MLLPLLLLLPMCWA

SEQ ID NO: 2865 - protein, 39 aa, Homo sapiens
MEFSSPSREECPKPLSRVSIMAGSLTGLLLLQAVSWASG

SEQ ID NO: 2866 - protein, 18 aa, Homo sapiens
MLCLLLTLGVALVCGVPA

SEQ ID NO: 2867 - protein, 19 aa, Homo sapiens
MYGKIIFVLLLSAIVSISA

SEQ ID NO: 2868 - protein, 19 aa, Homo sapiens
MYGKIIFVLLLSEIVSISA

SEQ ID NO: 2869 - protein, 19 aa, Homo sapiens
MYGKIIFVLLLSGIVSISA

SEQ ID NO: 2870 - protein, 24 aa, Homo sapiens
MDYYRKYAAIFLVTLSVFLHVLHS

SEQ ID NO: 2871 - protein, 23 aa, Homo sapiens
MELRARGWWLLCAAAALVACARG

SEQ ID NO: 2872 - protein, 21 aa, Homo sapiens
MAAAMPLALLVLLLLGPGGWC

SEQ ID NO: 2873 - protein, 27 aa, Homo sapiens
MAVTDSLSRAATVLATVLLLSFGSVAA

SEQ ID NO: 2874 - protein, 25 aa, Homo sapiens
MTPQSLLQTTLFLLSLLFLVQGAHG

SEQ ID NO: 2875 - protein, 24 aa, Homo sapiens
MARLGNCSLTWAALIILLLPGSLE

SEQ ID NO: 2876 - protein, 17 aa, Homo sapiens
MWLQSLLLLGTVACSIS

SEQ ID NO: 2877 - protein, 22 aa, Homo sapiens
MLLLVTSLLLCELPHPAFLLIP

SEQ ID NO: 2878 - DNA, 66 bp, Homo sapiens
atgcttctcctggtgacaagccttctgctctgtgagttaccacacccagcattcctcctgatccca

SEQ ID NO: 2879 - DNA, 66 bp, Homo sapiens
atgctgctgctcgtgacatctctgctgctgtgcgagctgccccaccccgcctttctgctgatcccc

SEQ ID NO: 2880 - protein, 26 aa, Homo sapiens
MRNSYRFLASSLSVVVSLLLIPEDVC

SEQ ID NO: 2881 - protein, 18 aa, Homo sapiens
MQPILLLLAFLLLPRADA

SEQ ID NO: 2882 - protein, 18 aa, Homo sapiens
MQPFLLLLAFLLTPGAGT

SEQ ID NO: 2883 - protein, 24 aa, Homo sapiens
MSRTAYTVGALLLLLGTLLPAAEG

SEQ ID NO: 2884 - protein, 19 aa, Homo sapiens
MKLASGFLVLWLSLGGGLA

SEQ ID NO: 2885 - protein, 26 aa, Homo sapiens
MAAGSRTSLLLAFGLLCLSWLQEGSA

SEQ ID NO: 2886 - protein, 34 aa, Homo sapiens
MARAALSAAPSNPRLLRVALLLLLLVAAGRRAAG

SEQ ID NO: 2887 - protein, 21 aa, Homo sapiens
MNAFLLFALCLLGAWAALAGG

SEQ ID NO: 2888 - protein, 18 aa, Homo sapiens
MSALGAVIALLLWGQLFA

SEQ ID NO: 2889 - protein, 31 aa, Homo sapiens
MLVRRGARAGPRMPRGWTALCLLSLLPSGFM

SEQ ID NO: 2890 - protein, 23 aa, Homo sapiens
MARVLGAPVALGLWSLCWSLAIA

SEQ ID NO: 2891 - protein, 35 aa, Homo sapiens
MLLRSKPALPPPLMLLLLGPLGPLSPGALPRPAQA

SEQ ID NO: 2892 - protein, 19 aa, Homo sapiens
MKHSLNALLIFLIITSAWG

SEQ ID NO: 2893 - protein, 22 aa, Homo sapiens
MDTSPLCFSILLVLCIFIQSSA

SEQ ID NO: 2894 - protein, 31 aa, Homo sapiens
MWVTKLLPALLLQHVLLHLLLLPIAIPYAEG

SEQ ID NO: 2895 - protein, 35 aa, Homo sapiens
MGRWAWVPSPWPPPGLGPFLLLLLLLLLLPRGFQP

SEQ ID NO: 2896 - protein, 22 aa, Homo sapiens
MGPRARPALLLLMLLQTAVLQG

SEQ ID NO: 2897 - protein, 15 aa, Homo sapiens
MWFLTTLLLWVPVDG

SEQ ID NO: 2898 - protein, 19 aa, Homo sapiens
MKFFVFALVLALMISMISA

SEQ ID NO: 2899 - protein, 19 aa, Homo sapiens
MKFFVFALILALMLSMTGA

SEQ ID NO: 2900 - protein, 18 aa, Homo sapiens
MKALIAALLLITLQYSCA

SEQ ID NO: 2901 - protein, 24 aa, Homo sapiens
MAVMAPRTLLLLLSGALALTQTWA

SEQ ID NO: 2902 - protein, 24 aa, Homo sapiens
MAVMAPRTLLLLLSGALALTHTWA

SEQ ID NO: 2903 - protein, 24 aa, Homo sapiens
MAVMAPRTLLLLLLGALALTQTWA

SEQ ID NO: 2904 - protein, 24 aa, Homo sapiens
MAIMAPRTLVLLLSGALALTQTWA

SEQ ID NO: 2905 - protein, 24 aa, Homo sapiens
MAVMPPRTLLLLLSGALALTQTWA

SEQ ID NO: 2906 - protein, 21 aa, Homo sapiens
MVDGTLLLLLSEALALTQTWA

SEQ ID NO: 2907 - protein, 21 aa, Homo sapiens
MAPRSLLLLLSGALALTDTWA

SEQ ID NO: 2908 - protein, 24 aa, Homo sapiens
MRVTAPRTVLLLLSGALALTETWA

SEQ ID NO: 2909 - protein, 24 aa, Homo sapiens
MRVTAPRTLLLLLWGAVALTETWA

SEQ ID NO: 2910 - protein, 24 aa, Homo sapiens
MRVTAPRTVLLLLSAALALTETWA

SEQ ID NO: 2911 - protein, 24 aa, Homo sapiens
MLVMAPRTVLLLLSAALALTETWA

SEQ ID NO: 2912 - protein, 24 aa, Homo sapiens
MRVTAPRTVLLLLWGAVALTETWA

SEQ ID NO: 2913 - protein, 24 aa, Homo sapiens
MRVTAPRTLLLLLWGALALTETWA

SEQ ID NO: 2914 - protein, 23 aa, Artificial Sequence
  source: /note="Description of Artificial Sequence: Synthetic peptide"
RVTAPRTLLLLLWGALALTETWA

SEQ ID NO: 2915 - protein, 24 aa, Homo sapiens
MRVMEPRTLILLLSGALALTETWA

SEQ ID NO: 2916 - protein, 24 aa, Homo sapiens
MRVMAPRTLILLLSGALALTETWA

SEQ ID NO: 2917 - protein, 24 aa, Homo sapiens
MRVMAPRTLLLLLSGALALTETWA

SEQ ID NO: 2918 - protein, 24 aa, Homo sapiens
MRVMAPQALLLLLSGALALIETWA

SEQ ID NO: 2919 - protein, 24 aa, Homo sapiens
MRVMAPRALLLLLSGGLALTETWA

SEQ ID NO: 2920 - protein, 25 aa, Homo sapiens
GSGWVPWVVALLVNLTRLDSSMTQG

SEQ ID NO: 2921 - protein, 28 aa, Homo sapiens
MRPEDRMFHIRAVILRALSLAFLLSLRG

SEQ ID NO: 2922 - protein, 29 aa, Homo sapiens
MMVLQVSAAPRTVALTALLMVLLTSVVQG

SEQ ID NO: 2923 - protein, 23 aa, Homo sapiens
MILNKALMLGALALTTVMSPCGG

SEQ ID NO: 2924 - protein, 32 aa, Artificial Sequence
  source: /note="Description of Artificial Sequence: Synthetic Signal Sequence"
MSWKKALRIPGGLRAATVTLMLSMLSTPVAEG

SEQ ID NO: 2925 - protein, 32 aa, Artificial Sequence
  source: /note="Description of Artificial Sequence: Synthetic Signal Sequence"
MSWKKALRIPGGLRVATVTLMLAMLSTPVAEG

SEQ ID NO: 2926 - protein, 23 aa, Homo sapiens
MILNKALLLGALALTTVMSPCGG

SEQ ID NO: 2927 - protein, 23 aa, Homo sapiens
MILNKALLLGALALTAVMSPCGG

SEQ ID NO: 2928 - protein, 32 aa, Artificial Sequence
  source: /note="Description of Artificial Sequence: Synthetic Signal Sequence"
MSWKKSLRIPGDLRVATVTLMLAILSSSLAEG

SEQ ID NO: 2929 - protein, 23 aa, Homo sapiens
MILNKALMLGSLALTTVMSPCGG

SEQ ID NO: 2930 - protein, 32 aa, Artificial Sequence
  source: /note="Description of Artificial Sequence: Synthetic Signal Sequence"
MSWKKALRIPGGLRVATVTLMLAMLSTSVAEG

SEQ ID NO: 2931 - protein, 32 aa, Artificial Sequence
  source: /note="Description of Artificial Sequence: Synthetic Signal Sequence"
MSWKKALRIPGDLRVATVTLMLAMLSSLLAEG

SEQ ID NO: 2932 - protein, 25 aa, Homo sapiens
MAISGVPVLGFFIIAVLMSAQESWA

SEQ ID NO: 2933 - protein, 29 aa, Homo sapiens
MVCLRLPGGSCMAVLTVTLMVLSSPLALA

SEQ ID NO: 2934 - protein, 29 aa, Homo sapiens
MVCLKLPGGSCMTALTVTLMVLSSPLALA

SEQ ID NO: 2935 - protein, 29 aa, Homo sapiens
MVCLKFPGGSCMAALTVTLMVLSSPLALA

SEQ ID NO: 2936 - protein, 29 aa, Homo sapiens
MVCLKLPGGSCMAALTVTLMVLSSPLALA

SEQ ID NO: 2937 - protein, 29 aa, Homo sapiens
MVCLKLPGGSSLAALTVTLMVLSSRLAFA

SEQ ID NO: 2938 - protein, 29 aa, Homo sapiens
MVCLKLPGGSCMAALTVTLTVLSSPLALA

SEQ ID NO: 2939 - protein, 32 aa, Artificial Sequence
  source: /note="Description of Artificial Sequence: Synthetic Signal Sequence"
MSWKMALQIPGGFWAAAVTVMLVMLSTPVAEA

SEQ ID NO: 2940 - protein, 23 aa, Homo sapiens
MFARMSDLHVLLLMALVGKTACG

SEQ ID NO: 2941 - protein, 19 aa, Homo sapiens
MDWTWRVFCLLAVAPGAHS

SEQ ID NO: 2942 - protein, 19 aa, Homo sapiens
  MOD_RES (5)..(8): Any amino acid
MDWTXXXXFLVAAATRVHS

SEQ ID NO: 2943 - protein, 19 aa, Homo sapiens
MDWTWRILFLVAAATGAHS

SEQ ID NO: 2944 - protein, 19 aa, Homo sapiens
MKHLWFLLLWCQLPDVGVL

SEQ ID NO: 2945 - protein, 19 aa, Homo sapiens
MDILCSTLLLLTVPSGVLS

SEQ ID NO: 2946 - protein, 19 aa, Homo sapiens
MEFGLSWLFLVAILKGVQC

SEQ ID NO: 2947 - protein, 20 aa, Homo sapiens
MGSQVHLLSFLLLWISDTRA

SEQ ID NO: 2948 - protein, 22 aa, Homo sapiens
MDMRVPAQLLGLLLLWLRRVRC

SEQ ID NO: 2949 - protein, 22 aa, Homo sapiens
MDMRVPAQLLGLLLLWLPGAKC

SEQ ID NO: 2950 - protein, 22 aa, Homo sapiens
MDMRVPAQLLGLLLLWLRGARC

SEQ ID NO: 2951 - protein, 4 aa, Homo sapiens
GSSG

SEQ ID NO: 2952 - protein, 20 aa, Homo sapiens
MRLPAQLLGLLMLWVPGSSG

SEQ ID NO: 2953 - protein, 20 aa, Homo sapiens
MEAPAQLLFLLLLWLPDTTG

SEQ ID NO: 2954 - protein, 20 aa, Homo sapiens
METPAQLLFLLLLWLPDTTG

SEQ ID NO: 2955 - protein, 4 aa, Artificial Sequence
  source: /note="Description of Artificial Sequence: Synthetic peptide"
VPSG

SEQ ID NO: 2956 - protein, 20 aa, Homo sapiens
MEAPAQLLFLLLLWLPDTTR

SEQ ID NO: 2957 - protein, 20 aa, Homo sapiens
MVLQTQVFISLLLWISGAYG

SEQ ID NO: 2958 - protein, 20 aa, Homo sapiens
MAWTPLFLFLLTCCPGGSNS

SEQ ID NO: 2959 - protein, 19 aa, Homo sapiens
MTCSPLLLTLLIHCTGSWA

SEQ ID NO: 2960 - protein, 19 aa, Homo sapiens
MAWAPLLLTLLAHCTDCWA

SEQ ID NO: 2961 - protein, 18 aa, Homo sapiens
MDWTWILFLVAAATRVHS

SEQ ID NO: 2962 - DNA, 54 bp, Homo sapiens
atggactggacatggatactcttcctggtagcagccgccacacgagtgcacagc

SEQ ID NO: 2963 - DNA, 54 bp, Homo sapiens
atggactggacctggattctgtttctggtggccgctgccacaagagtgcacagc

SEQ ID NO: 2964 - DNA, 54 bp, Homo sapiens
atggattggacctggattctgtttctggtggccgctgccacaagagtgcacagc

SEQ ID NO: 2965 - protein, 23 aa, Homo sapiens
MGVPRPQPWALGLLLFLLPGSLG

SEQ ID NO: 2966 - protein, 18 aa, Homo sapiens
MVLHLLLFLLLTPQGGHS

SEQ ID NO: 2967 - protein, 24 aa, Homo sapiens
MALWMRLLPLLALLALWGPDPAAA

SEQ ID NO: 2968 - protein, 24 aa, Homo sapiens
MAPRGCIVAVFAIFCISRLLCSHG

SEQ ID NO: 2969 - protein, 24 aa, Homo sapiens
MRPRCCILALVCWITVFLLQCSKG

SEQ ID NO: 2970 - protein, 27 aa, Homo sapiens
MGTGGRRGAAAAPLLVAVAALLLGAAG

SEQ ID NO: 2971 - protein, 20 aa, Homo sapiens
MDPRLPAWALVLLGPALVFA

SEQ ID NO: 2972 - protein, 30 aa, Homo sapiens
MKSGSGGGSPTSLWGLLFLSAALSLWPTSG

SEQ ID NO: 2973 - protein, 24 aa, Homo sapiens
MGIPMGKSMLVLLTFLAFASCCIA

SEQ ID NO: 2974 - protein, 25 aa, Homo sapiens
MSEVPVARVWLVLLLLTVQVGVTAG

SEQ ID NO: 2975 - protein, 39 aa, Homo sapiens
MLPRVGCPALPLPPPPLLPLLPLLLLLLGASGGGGGARA

SEQ ID NO: 2976 - protein, 27 aa, Homo sapiens
MQRARPTLWAAALTLLVLLRGPPVARA

SEQ ID NO: 2977 - protein, 21 aa, Homo sapiens
MLPLCLVAALLLAAGPGPSLG

SEQ ID NO: 2978 - protein, 26 aa, Homo sapiens
MERPSLRALLLGAAGLLLLLLPLSSS

SEQ ID NO: 2979 - protein, 27 aa, Homo sapiens
MALRKGGLALALLLLSWVALGPRSLEG

SEQ ID NO: 2980 - protein, 22 aa, Homo sapiens
MKGSIFTLFLFSVLFAISEVRS

SEQ ID NO: 2981 - protein, 29 aa, Homo sapiens
MGPERTGAAPLPLLLVLALSQGILNCCLA

SEQ ID NO: 2982 - protein, 32 aa, Homo sapiens
MGPGPSRAPRAPRLMLCALALMVAAGGCVVSA

SEQ ID NO: 2983 - protein, 39 aa, Homo sapiens
MFPTESAWLGKRGANPGPEAAVRETVMLLLCLGVPTGRP

SEQ ID NO: 2984 - protein, 41 aa, Homo sapiens
MGSRTPESPLHAVQLRWGPRRRPPLLPLLLLLLPPPPRVGG

SEQ ID NO: 2985 - protein, 23 aa, Homo sapiens
MAAAGQLCLLYLSAGLLSRLGAA

SEQ ID NO: 2986 - protein, 33 aa, Homo sapiens
MAGARSRDPWGASGICYLFGSLLVELLFSRAVA

SEQ ID NO: 2987 - protein, 18 aa, Homo sapiens
MWLFHTLLCIASLALLAA

SEQ ID NO: 2988 - protein, 31 aa, Homo sapiens
MARALCPLQALWLLEWVLLLLGPCAAPPAWA

SEQ ID NO: 2989 - protein, 25 aa, Homo sapiens
MKDSCITVMAMALLSGFFFFAPASS

SEQ ID NO: 2990 - protein, 16 aa, Homo sapiens
MALRVLLLTALTLCHG

SEQ ID NO: 2991 - protein, 30 aa, Homo sapiens
MAFPPRRRLRLGPRGLPLLLSGLLLPLCRA

SEQ ID NO: 2992 - protein, 19 aa, Homo sapiens
MTRTRAALLLFTALATSLG

SEQ ID NO: 2993 - protein, 20 aa, Homo sapiens
MNLQPIFWIGLISSVCCVFA

SEQ ID NO: 2994 - protein, 22 aa, Homo sapiens
MLGLRPPLLALVGLLSLGCVLS

SEQ ID NO: 2995 - protein, 27 aa, Homo sapiens
MAGPRPSPWARLLLAALISVSLSGTLA

SEQ ID NO: 2996 - protein, 19 aa, Homo sapiens
MVALPMVLVLLLVLSRGES

SEQ ID NO: 2997 - protein, 18 aa, Homo sapiens
MNQLSFLLFLIATTRGWS

SEQ ID NO: 2998 - protein, 28 aa, Artificial Sequence
  source: /note="Description of Artificial Sequence: Synthetic Signal Sequence"
MKPPRPVRTCSKVLVLLSLLAIHQTTTA

SEQ ID NO: 2999 - protein, 27 aa, Homo sapiens
MAPSSPRPALPALLVLLGALFPGPGNA

SEQ ID NO: 3000 - protein, 23 aa, Homo sapiens
MASPFALLMVLVVLSCKSSCSLG

SEQ ID NO: 3001 - protein, 23 aa, Homo sapiens
MALSFSLLMAVLVLSYKSICSLG

SEQ ID NO: 3002 - protein, 23 aa, Homo sapiens
MALPFALMMALVVLSCKSSCSLG

SEQ ID NO: 3003 - protein, 23 aa, Homo sapiens
MALTFALLVALLVLSCKSSCSVG

SEQ ID NO: 3004 - protein, 21 aa, Homo sapiens
MALPFVLLMALVVLNCKSICS

SEQ ID NO: 3005 - protein, 20 aa, Homo sapiens
MALPFALLMALVVLSCKSSC

SEQ ID NO: 3006 - protein, 23 aa, Homo sapiens
MARSFSLLMVVLVLSYKSICSLG

SEQ ID NO: 3007 - protein, 23 aa, Homo sapiens
MALTFYLLVALVVLSYKSFSSLG

SEQ ID NO: 3008 - protein, 21 aa, Homo sapiens
MTNKCLLQIALLLCFSTTALS

SEQ ID NO: 3009 - protein, 27 aa, Artificial Sequence
  source: /note="Description of Artificial Sequence: Synthetic Signal Sequence"
MSTKPDMIQKCLWLEILMGIFIAGTLS

SEQ ID NO: 3010 - protein, 21 aa, Homo sapiens
MALLFPLLAALVMTSYSPVGS

SEQ ID NO: 3011 - protein, 26 aa, Homo sapiens
MLLSQNAFIFRSLNLVLMVYISLVFG

SEQ ID NO: 3012 - protein, 17 aa, Homo sapiens
MALLFLLPLVMQGVSRA

SEQ ID NO: 3013 - protein, 30 aa, Homo sapiens
MAPRRARGCRTLGLPALLLLLLLRPPATRG

SEQ ID NO: 3014 - DNA, 90 bp, Homo sapiens
atggccccgcggcgggcgcgcggctgccggaccctcggtctcccggcgctgctactgctgctgctgctccggccgccggcgacgcggggc

SEQ ID NO: 3015 - protein, 24 aa, Homo sapiens
MKASSLAFSLLSAAFYLLWTPSTG

SEQ ID NO: 3016 - protein, 25 aa, Homo sapiens
MEICRGLRSHLITLLLFLFHSETIC

SEQ ID NO: 3017 - protein, 17 aa, Homo sapiens
MKVLLRLICFIALLISS

SEQ ID NO: 3018 - protein, 18 aa, Homo sapiens
MGFWILAILTILMYSTAA

SEQ ID NO: 3019 - protein, 19 aa, Homo sapiens
MWSLLLCGLSIALPLSVTA

SEQ ID NO: 3020 - protein, 18 aa, Homo sapiens
MHSSALLCCLVLLTGVRA

SEQ ID NO: 3021 - protein, 21 aa, Homo sapiens
MLPCLVVLLAALLSLRLGSDA

SEQ ID NO: 3022 - protein, 19 aa, Homo sapiens
MAWSLGSWLGGCLLVSALG

SEQ ID NO: 3023 - protein, 22 aa, Homo sapiens
MCPARSLLLVATLVLLDHLSLA

SEQ ID NO: 3024 - protein, 22 aa, Homo sapiens
MCHQQLVISWFSLVFLASPLVA

SEQ ID NO: 3025 - DNA, 66 bp, Homo sapiens
atgtgtcaccagcagttggtcatctcttggttttccctggtttttctggcatctcccctcgtggcc

SEQ ID NO: 3026 - DNA, 66 bp, Homo sapiens
atgtgccaccagcagctggtcatcagctggttctccctggtgtttctggcatcccctctggtggca

SEQ ID NO: 3027 - DNA, 66 bp, Homo sapiens
atgtgccaccagcagctggtcatcagctggttctccctggtgtttctggccagccctctggtggcc

SEQ ID NO: 3028 - DNA, 66 bp, Homo sapiens
atgtgccaccagcagctggtcatcagctggttctccctggtgtttctggcaagccctctggtggca

SEQ ID NO: 3029 - DNA, 66 bp, Homo sapiens
atgtgccaccagcagctggtcatcagctggttctccctggtgtttctggcatccccactggtggca

SEQ ID NO: 3030 - DNA, 66 bp, Homo sapiens
atgtgccaccaacagctcgtgatcagctggttctccctggtgttcctggctagccccctggtggcc

SEQ ID NO: 3031 - DNA, 66 bp, Homo sapiens
atgtgccaccagcagctggtcatctcttggttcagcctggtgtttctggcctcccccctggtggcc

SEQ ID NO: 3032 - DNA, 66 bp, Homo sapiens
atgtgccaccagcagctggtcatctcctggttctctctggtgtttctggcatctcctctggtggca

SEQ ID NO: 3033 - DNA, 66 bp, Homo sapiens
atgtgccaccagcagctggtcatctcttggttcagcctggtgtttctggcatccccactggtggca

SEQ ID NO: 3034 - protein, 32 aa, Homo sapiens
MGAARSPPSAVPGPLLGLLLLLLGVLAPGGAS

SEQ ID NO: 3035 - protein, 17 aa, Homo sapiens
MSLVLLSLAALCRSAVP

SEQ ID NO: 3036 - protein, 20 aa, Homo sapiens
MPVPWFLLSLALGRSPVVLS

SEQ ID NO: 3037 - protein, 23 aa, Homo sapiens
MTPGKTSLVSLLLLLSLEAIVKA

SEQ ID NO: 3038 - protein, 20 aa, Homo sapiens
MVKYLLLSILGLAFLSEAAA

SEQ ID NO: 3039 - protein, 18 aa, Homo sapiens
MNCRELPLTLWVLISVST

SEQ ID NO: 3040 - protein, 28 aa, Homo sapiens
MRHNWTPDLSPLWVLLLCAHVVTLLVRA

SEQ ID NO: 3041 - protein, 24 aa, Homo sapiens
MKLQCVSLWLLGTILILCSVDNHG

SEQ ID NO: 3042 - protein, 20 aa, Homo sapiens
MYRMQLLSCIALSLALVTNS

SEQ ID NO: 3043 - DNA, 60 bp, Homo sapiens
atgtaccgaatgcaactgctgagctgcatcgccctgagcctggcactcgtgaccaacagc

SEQ ID NO: 3044 - DNA, 60 bp, Homo sapiens
atgtacaggatgcagctgctgagctgcatcgccctgagcctggccctggtgaccaacagc

SEQ ID NO: 3045 - DNA, 60 bp, Homo sapiens
atgtacagaatgcagctgctgagctgcatcgccctgtccctcgccctggtgaccaactcc

SEQ ID NO: 3046 - DNA, 60 bp, Homo sapiens
atgtacaggatgcaactcctgtcttgcattgcactaagtcttgcacttgtcacaaacagt

SEQ ID NO: 3047 - protein, 21 aa, Homo sapiens
MDSYLLMWGLLTFIMVPGCQA

SEQ ID NO: 3048 - protein, 26 aa, Homo sapiens
MAAPALSWRLPLLILLLPLATSWASA

SEQ ID NO: 3049 - protein, 29 aa, Homo sapiens
MQTFTMVLEEIWTSLFMWFFYALIPCLLT

SEQ ID NO: 3050 - protein, 19 aa, Homo sapiens
MPRGWAAPLLLLLLQGGWG

SEQ ID NO: 3051 - protein, 33 aa, Homo sapiens
MAALQKSVSSFLMGTLATSCLLLLALLVQGGAA

SEQ ID NO: 3052 - protein, 21 aa, Homo sapiens
MMPKHCFLGFLISFFLTGVAG

SEQ ID NO: 3053 - protein, 51 aa, Homo sapiens
MNFQQRLQSLWTLARPFCPPLLATASQMQMVVLPCLGFTLLLWSQVSGAQG

SEQ ID NO: 3054 - protein, 32 aa, Homo sapiens
MRERPRLGEDSSLISLFLQVVAFLAMVMGTHT

SEQ ID NO: 3055 - protein, 19 aa, Homo sapiens
MSRLPVLLLLQLLVRPGLQ

SEQ ID NO: 3056 - protein, 19 aa, Homo sapiens
MMWTWALWMLPSLCKFSLA

SEQ ID NO: 3057 - protein, 24 aa, Homo sapiens
MGLTSQLLPPLFFLLACAGNFVHG

SEQ ID NO: 3058 - protein, 19 aa, Homo sapiens
MRMLLHLSLLALGAAYVYA

SEQ ID NO: 3059 - protein, 20 aa, Homo sapiens
MIIVAHVLLILLGATEILQA

SEQ ID NO: 3060 - protein, 29 aa, Homo sapiens
MNSFSTSAFGPVAFSLGLLLVLPAAFPAP

SEQ ID NO: 3061 - protein, 19 aa, Homo sapiens
MLAVGCALLAALLAAPGAA

SEQ ID NO: 3062 - protein, 22 aa, Homo sapiens
MLTLQTWLVQALFIFLTTESTG

SEQ ID NO: 3063 - protein, 25 aa, Homo sapiens
MFHVSFRYIFGLPPLILVLLPVASS

SEQ ID NO: 3064 - protein, 20 aa, Homo sapiens
MTILGTTFGMVFSLLQVVSG

SEQ ID NO: 3065 - protein, 20 aa, Homo sapiens
MTSKLAVALLAAFLISAALC

SEQ ID NO: 3066 - protein, 18 aa, Homo sapiens
MLLAMVLTSALLLCSVAG

SEQ ID NO: 3067 - protein, 17 aa, Homo sapiens
MMREWVLLMSVLLCGLA

SEQ ID NO: 3068 - protein, 19 aa, Homo sapiens
MHSFPPLLLLLFWGVVSHS

SEQ ID NO: 3069 - protein, 19 aa, Homo sapiens
MQGPWVLLLLGLRLQLSLG

SEQ ID NO: 3070 - protein, 27 aa, Homo sapiens
MGTKAQVERKLLCLFILAILLCSLALG

SEQ ID NO: 3071 - protein, 28 aa, Homo sapiens
MARRSRHRLLLLLLRYLVVALGYHKAYG

SEQ ID NO: 3072 - protein, 31 aa, Homo sapiens
MALRRPPRLRLCARLPDFFLLLLFRGCLIGA

SEQ ID NO: 3073 - protein, 19 aa, Homo sapiens
MFCPLKLILLPVLLDYSLG

SEQ ID NO: 3074 - protein, 22 aa, Homo sapiens
MARSLLLPLQILLLSLALETAG

SEQ ID NO: 3075 - protein, 20 aa, Homo sapiens
MKSFLLVVNALALTLPFLAV

SEQ ID NO: 3076 - protein, 30 aa, Homo sapiens
MLPPPRPAAALALPVLLLLLVVLTPPPTGA

SEQ ID NO: 3077 - protein, 31 aa, Homo sapiens
MHKWILTWILPTLLYRSCFHIICLVGTISLA

SEQ ID NO: 3078 - protein, 21 aa, Homo sapiens
MSLLVVSMACVGFFLLQGAWP

SEQ ID NO: 3079 - protein, 20 aa, Homo sapiens
MLRMRVPALLVLLFCFRGRA

SEQ ID NO: 3080 - protein, 18 aa, Homo sapiens
MKLITILFLCSRLLLSLT

SEQ ID NO: 3081 - protein, 25 aa, Homo sapiens
MKKTQTWILTCIYLQLLLFNPLVKT

SEQ ID NO: 3082 - protein, 23 aa, Homo sapiens
MEWWASSPLRLWLLLFLLPSAQG

SEQ ID NO: 3083 - protein, 35 aa, Homo sapiens
MAPARTMARARLAPAGIPAVALWLLCTLGLQGTQA

SEQ ID NO: 3084 - protein, 27 aa, Homo sapiens
MAQLCGLRRSRAFLALLGSLLLSGVLA

SEQ ID NO: 3085 - protein, 23 aa, Homo sapiens
MPRPRLLAALCGALLCAPSLLVA

SEQ ID NO: 3086 - protein, 21 aa, Homo sapiens
MKPVWVATLLWMLLLVPRLGA

SEQ ID NO: 3087 - protein, 19 aa, Homo sapiens
MELSWHVVFIALLSFSCWG

SEQ ID NO: 3088 - protein, 19 aa, Homo sapiens
MKLVFLVLLFLGALGLCLA

SEQ ID NO: 3089 - protein, 21 aa, Homo sapiens
MGLLQLLAFSFLALCRARVRA

SEQ ID NO: 3090 - protein, 33 aa, Homo sapiens
MRGSHRAAPALRPRGRLWPVLAVLAAAAAAGCA

SEQ ID NO: 3091 - protein, 21 aa, Homo sapiens
MAPLALHLLVLVPILLSLVAS

SEQ ID NO: 3092 - protein, 21 aa, Homo sapiens
MICQKFCVVLLHWEFIYVITA

SEQ ID NO: 3093 - protein, 35 aa, Homo sapiens
MSSWSRQRPKSPGGIQPHVSRTLFLLLLLAASAWG

SEQ ID NO: 3094 - protein, 25 aa, Homo sapiens
MARMSFVIAACQLVLGLLMTSLTES

SEQ ID NO: 3095 - protein, 35 aa, Homo sapiens
MGLQTTKWPSHGAFFLKSWLIISLGLYSQVSKLLA

SEQ ID NO: 3096 - protein, 47 aa, Homo sapiens
MGSLQHCCCLLPKMGDTWAQLPWPGPPHPAMLLISLLLAAGLMHSDA

SEQ ID NO: 3097 - protein, 22 aa, Homo sapiens
MKVLAAGVVPLLLVLHWKHGAG

SEQ ID NO: 3098 - protein, 23 aa, Homo sapiens
MYLWLKLLAFGFAFLDTEVFVTG

SEQ ID NO: 3099 - protein, 23 aa, Homo sapiens
MTPILTVLICLGLSLDPRTHVQA

SEQ ID NO: 3100 - protein, 19 aa, Homo sapiens
MATLLLLLGVLVVSPDALG

SEQ ID NO: 3101 - protein, 21 aa, Homo sapiens
MAQVKLQESGTELAKPGAAVK

SEQ ID NO: 3102 - protein, 18 aa, Artificial Sequence
  source: /note="Description of Artificial Sequence: Synthetic Signal Sequence"
MKPLLLAVSLGLIAALQA

SEQ ID NO: 3103 - protein, 25 aa, Homo sapiens
MGALARALPSILLALLLTSTPEALG

SEQ ID NO: 3104 - protein, 27 aa, Homo sapiens
MESKALLVLTLAVWLQSLTASRGGVAA

SEQ ID NO: 3105 - protein, 22 aa, Homo sapiens
MAQTSSYFMLISCLMFLSQSQG

SEQ ID NO: 3106 - protein, 18 aa, Homo sapiens
MWLRAFILATLSASAAWG

SEQ ID NO: 3107 - protein, 33 aa, Homo sapiens
MTMETQMSQNVCPRNLWLLQPLTVLLLLASADS

SEQ ID NO: 3108 - protein, 21 aa, Homo sapiens
MGPWGWKLRWTVALLLAAAGT

SEQ ID NO: 3109 - protein, 28 aa, Homo sapiens
MIFPWKCQSTQRDLWNIFKLWGWTMLCC

SEQ ID NO: 3110 - protein, 18 aa, Homo sapiens
MSLSAFTLFLALIGGTSG

SEQ ID NO: 3111 - protein, 31 aa, Homo sapiens
MEPPDAPAQARGAPRLLLLAVLLAAHPDAQA

SEQ ID NO: 3112 - protein, 20 aa, Homo sapiens
MEMLQGLLLLLLLSMGGAWA

SEQ ID NO: 3113 - protein, 25 aa, Homo sapiens
MAMGVPRVILLCLFGAALCLTGSQA

SEQ ID NO: 3114 - protein, 22 aa, Homo sapiens
MEPGPALAWLLLLSLLADCLKA

SEQ ID NO: 3115 - protein, 21 aa, Homo sapiens
MASRWAVQLLLVAAWSMGCGE

SEQ ID NO: 3116 - protein, 28 aa, Homo sapiens
MWEAQFLGLLFLQPLWVAPVKPLQPGAE

SEQ ID NO: 3117 - protein, 20 aa, Homo sapiens
MRTALLLLAALAVATGPALT

SEQ ID NO: 3118 - protein, 27 aa, Homo sapiens
MRTGWATPRRPAGLLMLLFWFFDLAEP

SEQ ID NO: 3119 - protein, 20 aa, Homo sapiens
MKGFTATLFLWTLIFPSCSG

SEQ ID NO: 3120 - protein, 28 aa, Homo sapiens
MVAGSDAGRALGVLSVVCLLHCFGFISC

SEQ ID NO: 3121 - protein, 34 aa, Homo sapiens
MTPPERLFLPRVCGTTLHLLLLGLLLVLLPGAQG

SEQ ID NO: 3122 - protein, 32 aa, Homo sapiens
MITGVFSMRLWTPVGVLTSLAYCLHQRRVALA

SEQ ID NO: 3123 - protein, 30 aa, Homo sapiens
MAGKRSGWSRAALLQLLLGVNLVVMPPTRA

SEQ ID NO: 3124 - protein, 49 aa, Homo sapiens
MGAYARASGVCARGCLDSAGPWTMSRALRPPLPPLCFFLLLLAAAGARA

SEQ ID NO: 3125 - protein, 28 aa, Homo sapiens
MIRAAPPPLFLLLLLLLLLVSWASRGEA

SEQ ID NO: 3126 - protein, 27 aa, Homo sapiens
MAPRSARRPLLLLLPVAAARPHALSSA

SEQ ID NO: 3127 - protein, 28 aa, Homo sapiens
MVCFRLFPVPGSGLVLVCLVLGAVRSYA

SEQ ID NO: 3128 - protein, 18 aa, Homo sapiens
MKALIVLGLVLLSVTVQG

SEQ ID NO: 3129 - protein, 32 aa, Homo sapiens
MTAPGAAGRCPPTTWLGSLLLLVCLLASRSIT

SEQ ID NO: 3130 - protein, 22 aa, Homo sapiens
MGELMAFLLPLIIVLMVKHSDS

SEQ ID NO: 3131 - protein, 18 aa, Homo sapiens
MKLLMVLMLAALLLHCYA

SEQ ID NO: 3132 - protein, 20 aa, Homo sapiens
MSLFPSLPLLLLSMVAASYS

SEQ ID NO: 3133 - protein, 15 aa, Homo sapiens
MRLILPVGLIATTLA

SEQ ID NO: 3134 - protein, 17 aa, Homo sapiens
MRLTVLCAVCLLPGSLA

SEQ ID NO: 3135 - protein, 19 aa, Homo sapiens
MKSLILLAILAALAVVTLC

SEQ ID NO: 3136 - protein, 19 aa, Homo sapiens
MSLWQPLVLVLLVLGCCFA

SEQ ID NO: 3137 - protein, 24 aa, Homo sapiens
MDLVLKRCLLHLAVIGALLAVGAT

SEQ ID NO: 3138 - protein, 24 aa, Homo sapiens
MARSLVCLGVIILLSAFSGPGVRG

SEQ ID NO: 3139 - protein, 19 aa, Homo sapiens
MRGPSGALWLLLALRTVLG

SEQ ID NO: 3140 - protein, 34 aa, Homo sapiens
MEPPGRRECPFPSWRFPGLLLAAMVLLLYSFSDA

SEQ ID NO: 3141 - protein, 17 aa, Artificial Sequence
  source: /note="Description of Artificial Sequence: Synthetic Signal Sequence"
MKLVNIWLLLLVVLLCG

SEQ ID NO: 3142 - protein, 36 aa, Homo sapiens
MALPTARPLLGSCGTPALGSLLFLLFSLGWVQPSRT

SEQ ID NO: 3143 - protein, 23 aa, Homo sapiens
MAPFEPLASGILLLLWLIAPSRA

SEQ ID NO: 3144 - protein, 26 aa, Homo sapiens
MGAAARTLRLALGLLLLATLLRPADA

SEQ ID NO: 3145 - protein, 23 aa, Homo sapiens
MTPWLGLIVLLGSWSLGDWGAEA

SEQ ID NO: 3146 - protein, 23 aa, Homo sapiens
MGLGPVFLLLAGIFPFAPPGAAA

SEQ ID NO: 3147 - protein, 21 aa, Homo sapiens
MKALLALPLLLLLSTPPCAPQ

SEQ ID NO: 3148 - protein, 20 aa, Homo sapiens
MQHRGFLLLTLLALLALTSA

SEQ ID NO: 3149 - protein, 20 aa, Homo sapiens
MKTLQSTLLLLLLVPLIKPA

SEQ ID NO: 3150 - protein, 19 aa, Homo sapiens
MERASCLLLLLLPLVHVSA

SEQ ID NO: 3151 - protein, 23 aa, Homo sapiens
MTPGTQSPFFLLLLLTVLTVVTG

SEQ ID NO: 3152 - protein, 20 aa, Homo sapiens
MKFLAVLVLLGVSIFLVSAQ

SEQ ID NO: 3153 - protein, 29 aa, Homo sapiens
MAPGAPSSSPSPILAVLLFSSLVLSPAQA

SEQ ID NO: 3154 - protein, 31 aa, Homo sapiens
MQQRGAAGSRGCALFPLLGVLFFQGVYIVFS

SEQ ID NO: 3155 - protein, 19 aa, Homo sapiens
MIFLTALPLFWIMISASRG

SEQ ID NO: 3156 - protein, 29 aa, Homo sapiens
MASLSRPSLPSCLCSFLLLLLLQVSSSYA

SEQ ID NO: 3157 - protein, 25 aa, Homo sapiens
MAHRPPSPALASVLLALLLSGAARA

SEQ ID NO: 3158 - protein, 48 aa, Homo sapiens
MGVPFFSSLRCMVDLGPCWAGGLTAEMKLLLALAGLLAILATPQPSEG

SEQ ID NO: 3159 - protein, 23 aa, Homo sapiens
MARKSNLPVLLVPFLLCQALVRC

SEQ ID NO: 3160 - protein, 26 aa, Homo sapiens
MAAVVAATRWWQLLLVLSAAGMGASG

SEQ ID NO: 3161 - protein, 36 aa, Homo sapiens
MRLLPLAPGRLRRGSPRHLPSCSPALLLLVLGGCLG

SEQ ID NO: 3162 - protein, 21 aa, Homo sapiens
MAQGVLWILLGLLLWSDPGTA

SEQ ID NO: 3163 - protein, 26 aa, Homo sapiens
MDPQTAPSRALLLLLFLHLAFLGGRS

SEQ ID NO: 3164 - protein, 21 aa, Homo sapiens
MLGQVVTLILLLLLKVYQGKG

SEQ ID NO: 3165 - protein, 19 aa, Homo sapiens
MAGPSLACCLLGLLALTSA

SEQ ID NO: 3166 - protein, 19 aa, Homo sapiens
MVVALRYVWPLLLCSPCLL

SEQ ID NO: 3167 - protein, 22 aa, Homo sapiens
MQLTRCCFVFLVQGSLYLVICG

SEQ ID NO: 3168 - protein, 15 aa, Homo sapiens
MLRVLVGAVLPAMLL

SEQ ID NO: 3169 - protein, 26 aa, Homo sapiens
MVSRMVSTMLSGLLFWLASGWTPAFA

SEQ ID NO: 3170 - protein, 41 aa, Homo sapiens
MSRPQGLLWLPLLFTPVCVMLNSNVLLWLTALAIKFTLIDS

SEQ ID NO: 3171 - protein, 24 aa, Homo sapiens
MARRAGGARMFGSLLLFALLAAGV

SEQ ID NO: 3172 - protein, 22 aa, Homo sapiens
MALERLCSVLKVLLITVLVVEG

SEQ ID NO: 3173 - protein, 21 aa, Homo sapiens
MERGLPLLCAVLALVLAPAGA

SEQ ID NO: 3174 - protein, 28 aa, Homo sapiens
MSGSSLPSALALSLLLVSGSLLPGPGAA

SEQ ID NO: 3175 - protein, 33 aa, Homo sapiens
MGVCGYLFLPWKCLVVVSLRLLFLVPTGVPVRS

SEQ ID NO: 3176 - protein, 20 aa, Homo sapiens
MFSLKTLPFLLLLHVQISKA

SEQ ID NO: 3177 - protein, 19 aa, Homo sapiens
MRTLAILAAILLVALQAQA

SEQ ID NO: 3178 - protein, 20 aa, Homo sapiens
MPLGLLWLGLALLGALHAQA

SEQ ID NO: 3179 - protein, 28 aa, Homo sapiens
MLASSSRIRAAWTRALLLPLLLAGPVGC

SEQ ID NO: 3180 - protein, 30 aa, Homo sapiens
MEGDRVAGRPVLSSLPVLLLLQLLMLRAAA

SEQ ID NO: 3181 - protein, 25 aa, Homo sapiens
MAAAAATKILLCLPLLLLLSGWSRA

SEQ ID NO: 3182 - protein, 34 aa, Homo sapiens
MESPSAPPHRWCIPWQRLLLTASLLTFWNPPTTA

SEQ ID NO: 3183 - protein, 27 aa, Homo sapiens
MVPKLFTSQICLLLLLGLLAVEGSLHV

SEQ ID NO: 3184 - protein, 19 aa, Homo sapiens
MRFLAATFLLLALSTAAQA

SEQ ID NO: 3185 - protein, 20 aa, Homo sapiens
MSCPVPACCALLLVLGLCRA

SEQ ID NO: 3186 - protein, 30 aa, Homo sapiens
DVSLCPAKCSFWRIFLLGSVWLDYVGSVLA

SEQ ID NO: 3187 - protein, 29 aa, Homo sapiens
MRAPGRPALRPLPLPPLLLLLLAAPWGRA

SEQ ID NO: 3188 - protein, 28 aa, Homo sapiens
MMVALRGASALLVLFLAAFLPPPQCTQD

SEQ ID NO: 3189 - protein, 24 aa, Homo sapiens
MEYQILKMSLCLFILLFLTPGILC

SEQ ID NO: 3190 - protein, 25 aa, Homo sapiens
MGVLLTQRTLLSLVLALLFPSMASM

SEQ ID NO: 3191 - protein, 17 aa, Homo sapiens
MARILLLFLPGLVAVCA

SEQ ID NO: 3192 - protein, 29 aa, Homo sapiens
MAAARLCLSLLLLSTCVALLLQPLLGAQG

SEQ ID NO: 3193 - protein, 23 aa, Homo sapiens
MKVTGIFLLSALALLSLSGNTGA

SEQ ID NO: 3194 - protein, 16 aa, Homo sapiens
MLPLWTLSLLLGAVAG

SEQ ID NO: 3195 - protein, 25 aa, Homo sapiens
MIPAKDMAKVMIVMLAICFLTKSDG

SEQ ID NO: 3196 - protein, 15 aa, Homo sapiens
MKWLLLLGLVALSEC

SEQ ID NO: 3197 - protein, 27 aa, Homo sapiens
MHGSCSFLMLLLPLLLLLVATTGPVGA

SEQ ID NO: 3198 - protein, 28 aa, Homo sapiens
MVFVRRPWPALTTVLLALLVCLGALVDA

SEQ ID NO: 3199 - protein, 20 aa, Homo sapiens
MGLPGLFCLAVLAASSFSKA

SEQ ID NO: 3200 - protein, 25 aa, Homo sapiens
MKVLLAAALIAGSVFFLLLPGPSAA

SEQ ID NO: 3201 - protein, 21 aa, Homo sapiens
MAARLLLLGILLLLLPLPVPA

SEQ ID NO: 3202 - protein, 24 aa, Homo sapiens
MGPPGSPWQWVTLLLGLLLPPAAP

SEQ ID NO: 3203 - protein, 22 aa, Homo sapiens
MGWTMRLVTAALLLGLMMVVTG

SEQ ID NO: 3204 - protein, 23 aa, Homo sapiens
MSAFRLWPGLLIMLGSLCHRGSP

SEQ ID NO: 3205 - protein, 21 aa, Homo sapiens
MLLAWVQAFLVSNMLLAEAYG

SEQ ID NO: 3206 - protein, 15 aa, Homo sapiens
MKLLVLAVLLTVAAA

SEQ ID NO: 3207 - protein, 20 aa, Homo sapiens
MKTLLLLAVIMIFGLLQAHG

SEQ ID NO: 3208 - protein, 17 aa, Homo sapiens
MALFGALFLALLAGAHA

SEQ ID NO: 3209 - protein, 18 aa, Homo sapiens
MPVMRLFPCFLQLLAGLA

SEQ ID NO: 3210 - protein, 18 aa, Homo sapiens
MRACISLVLAVLCGLAWA

SEQ ID NO: 3211 - protein, 19 aa, Homo sapiens
MILFKQATYFISLFATVSC

SEQ ID NO: 3212 - protein, 22 aa, Homo sapiens
MASRLTLLTLLLLLLAGDRASS

SEQ ID NO: 3213 - protein, 19 aa, Homo sapiens
MQLFLLLCLVLLSPQGASL

SEQ ID NO: 3214 - protein, 19 aa, Homo sapiens
MEHKEVVLLLLLFLKSGQG

SEQ ID NO: 3215 - protein, 23 aa, Homo sapiens
MQMSPALTCLVLGLALVFGEGSA

SEQ ID NO: 3216 - protein, 34 aa, Homo sapiens
MSLRLDTTPSCNSARPLHALQVLLLLSLLLTALA

SEQ ID NO: 3217 - protein, 27 aa, Homo sapiens
MQPRWAQGATMWLGVLLTLLLCSSLEG

SEQ ID NO: 3218 - protein, 31 aa, Homo sapiens
MSSAAGFCASRPGLLFLGLLLLPLVVAFASA

SEQ ID NO: 3219 - protein, 30 aa, Homo sapiens
MSSAARSRLTRATRQEMLFLALLLLPVVVA

SEQ ID NO: 3220 - protein, 16 aa, Homo sapiens
MPLLLLLLLLPSPLHP

SEQ ID NO: 3221 - protein, 26 aa, Homo sapiens
MGSGPRGALSLLLLLLAPPSRPAAGC

SEQ ID NO: 3222 - protein, 16 aa, Homo sapiens
MPAWGALFLLWATAEA

SEQ ID NO: 3223 - protein, 32 aa, Homo sapiens
MGVPTALEAGSWRWGSLLFALFLAASLGPVAA

SEQ ID NO: 3224 - protein, 21 aa, Homo sapiens
MVPPKLHVLFCLCGCLAVVYP

SEQ ID NO: 3225 - protein, 20 aa, Homo sapiens
MRTLACLLLLGCGYLAHVLA

SEQ ID NO: 3226 - protein, 20 aa, Homo sapiens
MNRCWALFLSLCCYLRLVSA

SEQ ID NO: 3227 - protein, 32 aa, Homo sapiens
MQAQQYQQQRRKFAAAFLAFIFILAAVDTAEA

SEQ ID NO: 3228 - protein, 18 aa, Homo sapiens
MLLFVLTCLLAVFPAIST

SEQ ID NO: 3229 - protein, 26 aa, Homo sapiens
MGLGARGAWAALLLGTLQVLALLGAA

SEQ ID NO: 3230 - protein, 25 aa, Homo sapiens
MRKDRLLHLCLVLLLILLSASDSNS

SEQ ID NO: 3231 - protein, 34 aa, Homo sapiens
MGTLSAPPCTQRIKWKGLLLTASLLNFWNLPTTA

SEQ ID NO: 3232 - protein, 34 aa, Homo sapiens
MGPLSAPPCTEHIKWKGLLVTASLLNFWNLPTTA

SEQ ID NO: 3233 - protein, 22 aa, Homo sapiens
MARAPPLLAALTALLAAAAAGG

SEQ ID NO: 3234 - protein, 16 aa, Homo sapiens
MYALFLLASLLGAALA

SEQ ID NO: 3235 - protein, 20 aa, Homo sapiens
MATPRGLGALLLLLLLPTSG

SEQ ID NO: 3236 - protein, 23 aa, Homo sapiens
MRGANAWAPLCLLLAAATQLSRQ

SEQ ID NO: 3237 - protein, 23 aa, Artificial Sequence
  source: /note="Description of Artificial Sequence: Synthetic Signal Sequence"
MKPIQKLLAGLILLTWCVEGCSS

SEQ ID NO: 3238 - protein, 19 aa, Homo sapiens
MIFLLLMLSLELQLHQIAA

SEQ ID NO: 3239 - protein, 19 aa, Homo sapiens
MRGATRVSIMLLLVTVSDC

SEQ ID NO: 3240 - protein, 27 aa, Homo sapiens
MRSLCCAPLLLLLLLPPLLLTPRAGDA

SEQ ID NO: 3241 - protein, 28 aa, Homo sapiens
MNIKGSPWKGSLLLLLVSNLLLCQSVAP

SEQ ID NO: 3242 - protein, 24 aa, Homo sapiens
MKENVASATVFTLLLFLNTCLLNG

SEQ ID NO: 3243 - protein, 28 aa, Homo sapiens
MRLLQLLFRASPATLLLVLCLQLGANKA

SEQ ID NO: 3244 - protein, 27 aa, Homo sapiens
MASSPWGCVCGLLLLLLPLLGTGPALG

SEQ ID NO: 3245 - protein, 17 aa, Homo sapiens
MIWYILIIGILLPQSLA

SEQ ID NO: 3246 - protein, 25 aa, Homo sapiens
MVSRKAVAALLVVHVAAMLASQTEA

SEQ ID NO: 3247 - protein, 28 aa, Homo sapiens
MLGNKRLGLSGLTLALSLLVCLGALAEA

SEQ ID NO: 3248 - protein, 27 aa, Homo sapiens
MITEGAQAPRLLLPPLLLLLTLPATGS

SEQ ID NO: 3249 - protein, 30 aa, Homo sapiens
MGTVSSRRSWWPLPLLLLLLLLLGPAGARA

SEQ ID NO: 3250 - protein, 35 aa, Homo sapiens
MGTVSSRRSWWPLPLLLLLLLLLGPAGARAQEDED

SEQ ID NO: 3251 - protein, 24 aa, Homo sapiens
MPRLFFFHLLGVCLLLNQFSRAVA

SEQ ID NO: 3252 - protein, 23 aa, Homo sapiens
MSRSLLLRFLLFLLLLPPLPVLL

SEQ ID NO: 3253 - protein, 22 aa, Homo sapiens
MATHHTLWMGLALLGVLGDLQA

SEQ ID NO: 3254 - protein, 20 aa, Homo sapiens
MKAVLLALLMAGLALQPGTA

SEQ ID NO: 3255 - protein, 17 aa, Homo sapiens
MWVPVVFLTLSVTWIGA

SEQ ID NO: 3256 - protein, 32 aa, Homo sapiens
MRAAPLLLARAASLSLGFLFLLFFWLDRSVLA

SEQ ID NO: 3257 - protein, 19 aa, Homo sapiens
MRSLGALLLLLSACLAVSA

SEQ ID NO: 3258 - protein, 21 aa, Homo sapiens
MWATQGLAVALALSVLPGSRA

SEQ ID NO: 3259 - protein, 31 aa, Homo sapiens
MAGLSRGSARALLAALLASTLLALLVSPARG

SEQ ID NO: 3260 - protein, 17 aa, Homo sapiens
MLRRALLCLAVAALVRA

SEQ ID NO: 3261 - protein, 24 aa, Homo sapiens
MRLRRLALFPGVALLLAAARLAAA

SEQ ID NO: 3262 - protein, 30 aa, Homo sapiens
MAGSRQRGLRARVRPLFCALLLSLGRFVRG

SEQ ID NO: 3263 - protein, 17 aa, Homo sapiens
MAVFLQLLPLLLSRAQG

SEQ ID NO: 3264 - protein, 21 aa, Homo sapiens
MESRVLLRTFCLIFGLGAVWG

SEQ ID NO: 3265 - protein, 31 aa, Homo sapiens
MQSVQSTSFCLRKQCLCLTFLLLHLLGQVAA

SEQ ID NO: 3266 - protein, 20 aa, Homo sapiens
MVYKTLFALCILTAGWRVQS

SEQ ID NO: 3267 - protein, 21 aa, Homo sapiens
MKVVPSLLLSVLLAQVWLVPG

SEQ ID NO: 3268 - protein, 22 aa, Homo sapiens
MASSIRRGRGAWTRLLSLLLLA

SEQ ID NO: 3269 - protein, 26 aa, Homo sapiens
MAVRELCFPRQRQVLFLFLFWGVSLA

SEQ ID NO: 3270 - protein, 41 aa, Homo sapiens
MANCQIAILYQRFQRVVFGISQLLCFSALISELTNQKEVAA

SEQ ID NO: 3271 - protein, 20 aa, Homo sapiens
MWLCPLALNLILMAASGAVC

SEQ ID NO: 3272 - protein, 20 aa, Homo sapiens
MWLCPLALNLILMAASGAAC

SEQ ID NO: 3273 - protein, 41 aa, Homo sapiens
MVGQMYCYPGSHLARALTRALALALVLALLVGPFLSGLAGA

SEQ ID NO: 3274 - protein, 19 aa, Homo sapiens
MRRLLEPCWWILFLKITSS

SEQ ID NO: 3275 - protein, 26 aa, Homo sapiens
MLPPMALPSVSWMLLSCLILLCQVQG

SEQ ID NO: 3276 - protein, 22 aa, Homo sapiens
MASRSMRLLLLLSCLAKTGVLG

SEQ ID NO: 3277 - protein, 25 aa, Homo sapiens
MARYMLLLLLAVWVLTGELWPGAEA

SEQ ID NO: 3278 - protein, 23 aa, Homo sapiens
MDGWRRMPRWGLLLLLWGSCTFG

SEQ ID NO: 3279 - protein, 26 aa, Homo sapiens
MELALRRSPVPRWLLLLPLLLGLNAG

SEQ ID NO: 3280 - protein, 18 aa, Homo sapiens
MKWVWALLLLAALGSGRA

SEQ ID NO: 3281 - protein, 28 aa, Homo sapiens
MALQRTHSLLLLLLLTLLGLGLVQPSYG

SEQ ID NO: 3282 - protein, 28 aa, Homo sapiens
MALEKSLVRLLLLVLILLVLGWVQPSLG

SEQ ID NO: 3283 - protein, 18 aa, Homo sapiens
MRPLLLLALLGWLLLAEA

SEQ ID NO: 3284 - protein, 16 aa, Homo sapiens
MLLILLSVALLAFSSA

SEQ ID NO: 3285 - protein, 28 aa, Homo sapiens
MGHHRPWLHASVLWAGVASLLLPPAMTQ

SEQ ID NO: 3286 - protein, 40 aa, Homo sapiens
MMLPQNSWHIDFGRCCCHQNLFSAVVTCILLLNSCFLISS

SEQ ID NO: 3287 - protein, 23 aa, Homo sapiens
MQLPLALCLVCLLVHTAFRVVEG

SEQ ID NO: 3288 - protein, 23 aa, Homo sapiens
MLPPAIHFYLLPLACILMKSCLA

SEQ ID NO: 3289 - protein, 20 aa, Homo sapiens
MKLMVLVFTIGLTLLLGVQA

SEQ ID NO: 3290 - protein, 31 aa, Homo sapiens
MGIGRSEGGRRGAALGVLLALGAALLAVGSA

SEQ ID NO: 3291 - protein, 24 aa, Homo sapiens
MLQGPGSLLLLFLASHCCLGSARG

SEQ ID NO: 3292 - protein, 32 aa, Homo sapiens
MVCGSPGGMLLLRAGLLALAALCLLRVPGARA

SEQ ID NO: 3293 - protein, 21 aa, Homo sapiens
MRLSVCLLMVSLALCCYQAHA

SEQ ID NO: 3294 - protein, 20 aa, Homo sapiens
MQPTLLLSLLGAVGLAAVNS

SEQ ID NO: 3295 - protein, 19 aa, Homo sapiens
MWRSLGLALALCLLPSGGT

SEQ ID NO: 3296 - protein, 38 aa, Homo sapiens
MGLRSWLAAPWGALPPRPPLLLLLLLLLLLQPPPPTWA

SEQ ID NO: 3297 - protein, 25 aa, Homo sapiens
MQTPRASPPRPALLLLLLLLGGAHG

SEQ ID NO: 3298 - protein, 23 aa, Artificial Sequence
  source: /note="Description of Artificial Sequence: Synthetic Signal Sequence"
MKPNIIFVLSLLLILEKQAAVMG

SEQ ID NO: 3299 - protein, 23 aa, Homo sapiens
MKSIILFVLSLLLILEKQAAVMG

SEQ ID NO: 3300 - protein, 27 aa, Homo sapiens
MMQKLLKCSRLVLALALILVLESSVQG

SEQ ID NO: 3301 - protein, 23 aa, Homo sapiens
MALSVLRLALLLLAVTFAASLIP

SEQ ID NO: 3302 - protein, 23 aa, Homo sapiens
MKLSGMFLLLSLALFCFLTGVFS

SEQ ID NO: 3303 - protein, 19 aa, Homo sapiens
MRLAVGALLVCAVLGLCLA

SEQ ID NO: 3304 - protein, 18 aa, Homo sapiens
MKWVTFISLLFLFSSAYS

SEQ ID NO: 3305 - protein, 18 aa, Homo sapiens
MKLLTGLVFCSLVLGVSS

SEQ ID NO: 3306 - protein, 18 aa, Homo sapiens
MRLFTGIVFCSLVMGVTS

SEQ ID NO: 3307 - protein, 19 aa, Homo sapiens
MNKPLLWISVLTSLLEAFA

SEQ ID NO: 3308 - protein, 29 aa, Homo sapiens
MESRGPLATSRLLLLLLLLLLRHTRQGWA

SEQ ID NO: 3309 - protein, 47 aa, Homo sapiens
MTGERPSTALPDRRWGPRILGFWGGCRVWVFAAIFLLLSLAASWSKA

SEQ ID NO: 3310 - protein, 18 aa, Homo sapiens
MFALGLPFLVLLVASVES

SEQ ID NO: 3311 - protein, 21 aa, Homo sapiens
MAQHHLWILLLCLQTWPEAAG

SEQ ID NO: 3312 - protein, 21 aa, Homo sapiens
MLWLFQSLLFVFCFGPGNVVS

SEQ ID NO: 3313 - protein, 22 aa, Homo sapiens
MAGSPTCLTLIYILWQLTGSAA

SEQ ID NO: 3314 - protein, 22 aa, Homo sapiens
MVMRPLWSLLLWEALLPITVTG

SEQ ID NO: 3315 - protein, 24 aa, Homo sapiens
MLSCRLQCALAALSIVLALGCVTG

SEQ ID NO: 3316 - protein, 26 aa, Homo sapiens
MATGSRTSLLLAFGLLCLPWLQEGSA

SEQ ID NO: 3317 - protein, 17 aa, Homo sapiens
MRAWIFFLLCLAGRALA

SEQ ID NO: 3318 - protein, 46 aa, Homo sapiens
MPRYGASLRQSCPRSGREQGQDGTAGAPGLLWMGLVLALALALALA

SEQ ID NO: 3319 - protein, 17 aa, Homo sapiens
MLQNSAVLLVLVISASA

SEQ ID NO: 3320 - protein, 19 aa, Homo sapiens
MKFLVFAFILALMVSMIGA

SEQ ID NO: 3321 - protein, 21 aa, Homo sapiens
MPLRKMKIPFLLLFFLWEAES

SEQ ID NO: 3322 - protein, 14 aa, Homo sapiens
MLVLGLLVAGAADG

SEQ ID NO: 3323 - protein, 22 aa, Artificial Sequence
  source: /note="Description of Artificial Sequence: Synthetic Signal Sequence"
MKSLTWILGLWALAACFTPGES

SEQ ID NO: 3324 - protein, 33 aa, Homo sapiens
MAAPALGLVCGRCPELGLVLLLLLLSLLCGAAG

SEQ ID NO: 3325 - protein, 19 aa, Homo sapiens
MGSGLPLVLLLTLLGSSHG

SEQ ID NO: 3326 - protein, 20 aa, Homo sapiens
MKSLSLLLAVALGLATAVSA

SEQ ID NO: 3327 - protein, 18 aa, Homo sapiens
MGTQEGWCLLLCLALSGA

SEQ ID NO: 3328 - protein, 21 aa, Homo sapiens
MDMWTALLILQALLLPSLADG

SEQ ID NO: 3329 - protein, 25 aa, Homo sapiens
MAGPPRLLLLPLLLALARGLPGALA

SEQ ID NO: 3330 - protein, 27 aa, Homo sapiens
MAMLLGASVLILWLQPDWVNSQQKNDD

SEQ ID NO: 3331 - protein, 20 aa, Homo sapiens
IFASLLRAVIASICVVSSMA

SEQ ID NO: 3332 - protein, 20 aa, Homo sapiens
MLLLLVPVLEVIFTLGGTRA

SEQ ID NO: 3333 - protein, 21 aa, Homo sapiens
MGTSLLCWMALCLLGADHADT

SEQ ID NO: 3334 - protein, 20 aa, Homo sapiens
MRWALLVLLAFLSPASQKSS

SEQ ID NO: 3335 - protein, 24 aa, Homo sapiens
MSFPCKFVASFLLIFNVSSKGAVS

SEQ ID NO: 3336 - protein, 16 aa, Homo sapiens
MLFLLLPLLAVLPGDG

SEQ ID NO: 3337 - protein, 19 aa, Homo sapiens
MLLLFLLFEGLCCPGENTA

SEQ ID NO: 3338 - protein, 21 aa, Homo sapiens
MEHSTFLSGLVLATLLSQVSP

SEQ ID NO: 3339 - protein, 22 aa, Homo sapiens
MQSGTHWRVLGLCLLSVGVWGQ

SEQ ID NO: 3340 - protein, 22 aa, Homo sapiens
MEQGKGLAVLILAIILLQGTLA

SEQ ID NO: 3341 - protein, 21 aa, Homo sapiens
MKWKALFTAAILQAQLPITEA

SEQ ID NO: 3342 - protein, 25 aa, Homo sapiens
MNRGVPFRHLLLVLQLALLPAATQG

SEQ ID NO: 3343 - protein, 24 aa, Homo sapiens
MPMGSLQPLATLYLLGMLVASCLG

SEQ ID NO: 3344 - protein, 21 aa, Homo sapiens
MRPRLWLLLAAQLTVLHGNSV

SEQ ID NO: 3345 - protein, 18 aa, Homo sapiens
MLRLLLALNLFPSIQVTG

SEQ ID NO: 3346 - protein, 22 aa, Homo sapiens
MGAMTQLLAGVFLAFLALATEG

SEQ ID NO: 3347 - protein, 30 aa, Homo sapiens
MDCRKMARFSYSVIWIMAISKVFELGLVAG

SEQ ID NO: 3348 - protein, 22 aa, Homo sapiens
MRAPGCGRLVLPLLLLAAAALA

SEQ ID NO: 3349 - protein, 21 aa, Homo sapiens
MELWGAYLLLCLFSLLTQVTT

SEQ ID NO: 3350 - protein, 22 aa, Homo sapiens
MGRGLLRGLWPLHIVLWTRIAS

SEQ ID NO: 3351 - protein, 26 aa, Homo sapiens
METRPRLGATCLLGFSFLLLVISSDG

SEQ ID NO: 3352 - protein, 29 aa, Homo sapiens
MHPAVFLSLPDLRCSLLLLVTWVFTPVTT

SEQ ID NO: 3353 - protein, 18 aa, Homo sapiens
MLGVLVLGALALAGLGFP

SEQ ID NO: 3354 - protein, 21 aa, Homo sapiens
MELTELLLVVMLLLTARLTLS

SEQ ID NO: 3355 - protein, 18 aa, Homo sapiens
MGLAWGLGVLFLMHVCGT

SEQ ID NO: 3356 - protein, 19 aa, Homo sapiens
MNLAISIALLLTVLQVSRG

SEQ ID NO: 3357 - protein, 19 aa, Homo sapiens
MALVLEIFTLLASICWVSA

SEQ ID NO: 3358 - protein, 20 aa, Homo sapiens
MRPADLLQLVLLLDLPRDLG

SEQ ID NO: 3359 - protein, 20 aa, Homo sapiens
MTALFLMSMLFGLACGQAMS

SEQ ID NO: 3360 - protein, 20 aa, Homo sapiens
MSPFLYLVLLVLGLHATIHC

SEQ ID NO: 3361 - protein, 32 aa, Homo sapiens
METPAWPRVPRPETAVARTLLLGWVFAQVAGA

SEQ ID NO: 3362 - protein, 28 aa, Homo sapiens
MIYTMKKVHALWASVCLLLNLAPAPLNA

SEQ ID NO: 3363 - protein, 22 aa, Homo sapiens
MDPARPLGLSILLLFLTEAALG

SEQ ID NO: 3364 - protein, 22 aa, Homo sapiens
MDAMKRGLCCVLLLCGAVFVSP

SEQ ID NO: 3365 - protein, 34 aa, Homo sapiens
MGHTRRQGTSPSKCPYLNFFQLLVLAGLSHFCSG

SEQ ID NO: 3366 - protein, 37 aa, Homo sapiens
MAAAWPSGPSAPEAVTARLVGVLWFVSVTTGPWGAVA

SEQ ID NO: 3367 - protein, 24 aa, Homo sapiens
MTSIFHFAIIFMLILQIRIQLSEE

SEQ ID NO: 3368 - protein, 23 aa, Homo sapiens
MRQTLPCIYFWGGLLPFGMLCAS

SEQ ID NO: 3369 - protein, 23 aa, Homo sapiens
MMSASRLAGTLIPAMAFLSCVRP

SEQ ID NO: 3370 - protein, 20 aa, Homo sapiens
MGDHLDLLLGVVLMAGPVFG

SEQ ID NO: 3371 - protein, 40 aa, Homo sapiens
MVLWESPRQCSSWTLCEGFCWLLLLPVMLLIVARPVKLAA

SEQ ID NO: 3372 - protein, 23 aa, Homo sapiens
MRQSHQLPLVGLLLFSFIPSQLC

SEQ ID NO: 3373 - protein, 18 aa, Homo sapiens
MRHLGAFLFLLGVLGALT

SEQ ID NO: 3374 - protein, 29 aa, Homo sapiens
MPPSGLRLLLLLLPLLWLLVLTPGRPAAG

SEQ ID NO: 3375 - protein, 18 aa, Homo sapiens
MRLLPRLLLLLLLVFPAT

SEQ ID NO: 3376 - protein, 22 aa, Homo sapiens
MGSPGMVLGLLVQIWALQEASS

SEQ ID NO: 3377 - protein, 26 aa, Homo sapiens
MALPPGPAALRHTLLLLPALLSSGWG

SEQ ID NO: 3378 - protein, 33 aa, Homo sapiens
MWGARRSSVSSSWNAASLLQLLLAALLAAGARA

SEQ ID NO: 3379 - protein, 30 aa, Homo sapiens
MAAACGPGAAGYCLLLGLHLFLLTAGPALG

SEQ ID NO: 3380 - protein, 33 aa, Homo sapiens
MATLWGGLLRLGSLLSLSCLALSVLLLAQLSDA

SEQ ID NO: 3381 - protein, 20 aa, Homo sapiens
MASHRLLLLCLAGLVFVSEA

SEQ ID NO: 3382 - protein, 24 aa, Homo sapiens
MATMENKVICALVLVSMLALGTLA

SEQ ID NO: 3383 - protein, 21 aa, Homo sapiens
MAARALCMLGLVLALLSSSSA

SEQ ID NO: 3384 - protein, 19 aa, Homo sapiens
MGLQACLLGLFALILSGKC

SEQ ID NO: 3385 - protein, 15 aa, Homo sapiens
MNPLLILTFVAAALA

SEQ ID NO: 3386 - protein, 15 aa, Homo sapiens
MNLLLILTFVAAAVA

SEQ ID NO: 3387 - protein, 21 aa, Homo sapiens
MWRCPLGLLLLLPLAGHLALG

SEQ ID NO: 3388 - protein, 55 aa, Homo sapiens
MEQRGQNAPAASGARKRHGPGPREARGARPGPRVPKTLVLVVAAVLLLVSAESAL

SEQ ID NO: 3389 - protein, 23 aa, Homo sapiens
MARIPKTLKFVVVIVAVLLPVLA

SEQ ID NO: 3390 - protein, 55 aa, Homo sapiens
MGLWGQSVPTASSARAGRYPGARTASGTRPWLLDPKILKFVVFIVAVLLPVRVDS

SEQ ID NO: 3391 - protein, 21 aa, Homo sapiens
MNKLLCCALVFLDISIKWTTQ

SEQ ID NO: 3392 - protein, 38 aa, Homo sapiens
MEPPGDWGPPPWRSTPKTDVLRLVLYLTFLGAPCYAPA

SEQ ID NO: 3393 - protein, 28 aa, Homo sapiens
MGAGATGRAMDGPRLLLLLLLGVSLGGA

SEQ ID NO: 3394 - protein, 25 aa, Homo sapiens
MAQHGAMGAFRALCGLALLCALSLG

SEQ ID NO: 3395 - protein, 29 aa, Homo sapiens
MALKVLLEQEKTFFTLLVLLGYLSCKVTC

SEQ ID NO: 3396 - protein, 25 aa, Artificial Sequence
  source: /note="Description of Artificial Sequence: Synthetic Signal Sequence"
MKPSLLCRPLSCFLMLLPWPLATLT

SEQ ID NO: 3397 - protein, 21 aa, Homo sapiens
MGLSTVPDLLLPLVLLELLVG

SEQ ID NO: 3398 - protein, 22 aa, Homo sapiens
MAPVAVWAALAVGLELWAAAHA

SEQ ID NO: 3399 - protein, 20 aa, Homo sapiens
MVRLPLQCVLWGCLLTAVHP

SEQ ID NO: 3400 - protein, 29 aa, Homo sapiens
MRALEGPGLSLLCLVLALPALLPVPAVRG

SEQ ID NO: 3401 - protein, 18 aa, Homo sapiens
MRVLLAALGLLFLGALRA

SEQ ID NO: 3402 - protein, 23 aa, Homo sapiens
MGNSCYNIVATLLLVLNFERTRS

SEQ ID NO: 3403 - protein, 26 aa, Homo sapiens
MAHVGDCTQTPWLPVLVVSLMCSARA

SEQ ID NO: 3404 - protein, 17 aa, Homo sapiens
MIILIYLFLLLWEDTQG

SEQ ID NO: 3405 - protein, 21 aa, Homo sapiens
MVWRVPPFLLPILFLASHVGA

SEQ ID NO: 3406 - protein, 23 aa, Homo sapiens
MDSLRKMLISVAMLGAGAGVGYA

SEQ ID NO: 3407 - protein, 22 aa, Homo sapiens
MGHPPLLPLLLLLHTCVPASWG

SEQ ID NO: 3408 - protein, 20 aa, Homo sapiens
MRALLARLLLCVLVVSDSKG

SEQ ID NO: 3409 - protein, 24 aa, Homo sapiens
MGQPSLTWMLMVVVASWFITTAAT

SEQ ID NO: 3410 - protein, 20 aa, Homo sapiens
MYKLASCCLLFIGFLNPLLS

SEQ ID NO: 3411 - protein, 21 aa, Homo sapiens
MKLAVTLTLVTLALCCSSASA

SEQ ID NO: 3412 - protein, 37 aa, Homo sapiens
MVAVLGGRGVLRLRLLLSALKPGIHVPRAGPAAAFGT

SEQ ID NO: 3413 - protein, 24 aa, Homo sapiens
MPGKMVVILGASNILWIMFAASQA

SEQ ID NO: 3414 - protein, 26 aa, Homo sapiens
MNFLLSWVHWSLALLLYLHHAKWSQA

SEQ ID NO: 3415 - protein, 31 aa, Homo sapiens
MHLLGFFSVACSLLAAALLPGPREAPAAAAA

SEQ ID NO: 3416 - protein, 26 aa, Homo sapiens
MVSYWDTGVLLCALLSCLLLTGSSSG

SEQ ID NO: 3417 - protein, 24 aa, Homo sapiens
MQRGAALCLRLWLCLGLLDGLVSG

SEQ ID NO: 3418 - protein, 19 aa, Homo sapiens
MPDTMLPACFLGLLAFSSA

SEQ ID NO: 3419 - protein, 21 aa, Homo sapiens
MKVLISSLLLLLPLMLMSMVS

SEQ ID NO: 3420 - protein, 20 aa, Homo sapiens
MFINIKSILWMCSTLIVTHA

SEQ ID NO: 3421 - protein, 16 aa, Homo sapiens
MKRVLVLLLAVAFGHA

SEQ ID NO: 3422 - protein, 32 aa, Homo sapiens
MWQLTSLLLFVATWGISGTPAPLDSVFSSSER

SEQ ID NO: 3423 - protein, 24 aa, Homo sapiens
MRVLGGRCGALLACLLLVLPVSEA

SEQ ID NO: 3424 - protein, 23 aa, Homo sapiens
MAGCVPLLQGLVLVLALHRVEPS

SEQ ID NO: 3425 - protein, 24 aa, Homo sapiens
MERGAGAKLLPLLLLLRATGFTCA

SEQ ID NO: 3426 - protein, 19 aa, Homo sapiens
MAPLRPLLILALLAWVALA

SEQ ID NO: 3427 - protein, 22 aa, Homo sapiens
MIPARFAGVLLALALILPGTLC

SEQ ID NO: 3428 - protein, 23 aa, Homo sapiens
MAELPGPFLCGALLGFLCLSGLA

SEQ ID NO: 3429 - protein, 19 aa, Homo sapiens
MGILLGLLLLGHLTVDTYG

SEQ ID NO: 3430 - protein, 16 aa, Artificial Sequence
  source: /note="Description of Artificial Sequence: Synthetic Signal Sequence"
MTAEFLSLLCLGLCLG

SEQ ID NO: 3431 - protein, 23 aa, Homo sapiens
MRGTPKTHLLAFSLLCLLSKVRT

SEQ ID NO: 3432 - protein, 28 aa, Homo sapiens
MARKLSVILILTFALSVTNPLHELKAAA

SEQ ID NO: 3433 - protein, 17 aa, Homo sapiens
MVPVLLSLLLLLGPAVP

SEQ ID NO: 3434 - protein, 38 aa, Homo sapiens
MACRQRGGSWSPSGWFNAGWSTYRSISLFFALVTSGNS

SEQ ID NO: 3435 - protein, 16 aa, Homo sapiens
MLTVALLALLCASASG

SEQ ID NO: 3436 - protein, 9 aa, Homo sapiens
SARNRQKRS

SEQ ID NO: 3437 - DNA, 27 bp, Homo sapiens
agcgccaggaatcgccagaagcggtcc

SEQ ID NO: 3438 - protein, 8 aa, Homo sapiens
ARNRQKRS

SEQ ID NO: 3439 - DNA, 24 bp, Homo sapiens
gcccggaatagacagaagagatct

SEQ ID NO: 3440 - protein, 12 aa, Artificial Sequence
  source: /note="Description of Artificial Sequence: Synthetic Cleavage site sequence"
ESRRVRRNKRSK

SEQ ID NO: 3441 - DNA, 36 bp, Artificial Sequence
  source: /note="Description of Artificial Sequence: Synthetic Cleavage site sequence"
gagtctaggcgcgtgcggagaaataagcggagcaag

SEQ ID NO: 3442 - DNA, 36 bp, Artificial Sequence
  source: /note="Description of Artificial Sequence: Synthetic Cleavage site sequence"
gagtctcggagagtgaggcgcaataagaggagcaag

SEQ ID NO: 3443 - DNA, 36 bp, Artificial Sequence
  source: /note="Description of Artificial Sequence: Synthetic Cleavage site sequence"
gagtccaggagagtgcggcgcaacaagaggagcaag

SEQ ID NO: 3444 - DNA, 36 bp, Artificial Sequence
  source: /note="Description of Artificial Sequence: Synthetic Cleavage site sequence"
gagtccaggagagtgcggcgcaacaagcggtctaag

SEQ ID NO: 3445 - DNA, 36 bp, Artificial Sequence
  source: /note="Description of Artificial Sequence: Synthetic Cleavage site sequence"
gagtctcggcgcgtgaggagaaataagagaagcaag

SEQ ID NO: 3446 - DNA, 36 bp, Artificial Sequence
  source: /note="Description of Artificial Sequence: Synthetic Cleavage site sequence"
gagtctaggagagtgcggcgcaataagagaagcaag

SEQ ID NO: 3447 - protein, 14 aa, Artificial Sequence
  source: /note="Description of Artificial Sequence: Synthetic Cleavage site sequence"
SGESRRVRRNKRSK

SEQ ID NO: 3448 - DNA, 42 bp, Artificial Sequence
  source: /note="Description of Artificial Sequence: Synthetic Cleavage site sequence"
agtggtgagtccaggagagtgcggcgcaacaagaggagcaag

SEQ ID NO: 3449 - protein, 19 aa, Artificial Sequence
  source: /note="Description of Artificial Sequence: Synthetic Cleavage site sequence"
ATNFSLLKQAGDVEENPGP

SEQ ID NO: 3450 - DNA, 57 bp, Artificial Sequence
  source: /note="Description of Artificial Sequence: Synthetic Cleavage site sequence"
gctactaacttcagcctgctgaagcaggctggagacgtggaggagaaccctggacct

SEQ ID NO: 3451 - DNA, 57 bp, Artificial Sequence
  source: /note="Description of Artificial Sequence: Synthetic Cleavage site sequence"
gcaaccaattttagtctacttaaacaagcaggtgatgtagaagaaaatccaggtcca

SEQ ID NO: 3452 - protein, 20 aa, Artificial Sequence
  source: /note="Description of Artificial Sequence: Synthetic Cleavage site sequence"
GATNFSLLKQAGDVEENPGP

SEQ ID NO: 3453 - DNA, 60 bp, Artificial Sequence
  source: /note="Description of Artificial Sequence: Synthetic Cleavage site sequence"
ggagctactaacttcagcctgctgaagcaggctggagacgtggaggagaaccctggacct

SEQ ID NO: 3454 - protein, 5 aa, Unknown
  source: /note="Description of Unknown: Granzyme B sequence"
  MOD_RES (5)..(5): Any amino acid
IEPDX

SEQ ID NO: 3455 - protein, 5 aa, Unknown
  source: /note="Description of Unknown: Enterokinase sequence"
DDDDK

SEQ ID NO: 3456 - protein, 6 aa, Unknown
  source: /note="Description of Unknown: Genenase sequence"
PGAAHY

SEQ ID NO: 3457 - protein, 7 aa, Unknown
  source: /note="Description of Unknown: PreScission protease sequence"
LEVFQGP

SEQ ID NO: 3458 - protein, 6 aa, Unknown
  source: /note="Description of Unknown: Thrombin sequence"
LVPRGS

SEQ ID NO: 3459 - protein, 7 aa, Unknown
  source: /note="Description of Unknown: TEV protease sequence"
ENLYFQG

SEQ ID NO: 3460 - protein, 4 aa, Artificial Sequence
  source: /note="Description of Artificial Sequence: Synthetic peptide"
RTKR

SEQ ID NO: 3461 - DNA, 12 bp, Artificial Sequence
  source: /note="Description of Artificial Sequence: Synthetic Cleavage site sequence"
agaacgaagaga

SEQ ID NO: 3462 - protein, 20 aa, Artificial Sequence
  source: /note="Description of Artificial Sequence: Synthetic peptide"
GTGAEDPRPSRKRRSLGDVG

SEQ ID NO: 3463 - protein, 14 aa, Artificial Sequence
  source: /note="Description of Artificial Sequence: Synthetic peptide"
GTGAEDPRPSRKRR

SEQ ID NO: 3464 - protein, 15 aa, Artificial Sequence
  source: /note="Description of Artificial Sequence: Synthetic peptide"
LQWLEQQVAKRRTKR

SEQ ID NO: 3465 - protein, 18 aa, Artificial Sequence
  source: /note="Description of Artificial Sequence: Synthetic peptide"
GTGAEDPRPSRKRRSLGG

SEQ ID NO: 3466 - protein, 17 aa, Artificial Sequence
  source: /note="Description of Artificial Sequence: Synthetic peptide"
GTGAEDPRPSRKRRSLG

SEQ ID NO: 3467 - protein, 14 aa, Artificial Sequence
  source: /note="Description of Artificial Sequence: Synthetic peptide"
SLNLTESHNSRKKR

SEQ ID NO: 3468 - protein, 14 aa, Artificial Sequence
  source: /note="Description of Artificial Sequence: Synthetic peptide"
CKINGYPKRGRKRR

SEQ ID NO: 3469 - protein, 4 aa, Artificial Sequence
  source: /note="Description of Artificial Sequence: Synthetic peptide"
RGDS

SEQ ID NO: 3470 - protein, 8 aa, Artificial Sequence
  source: /note="Description of Artificial Sequence: Synthetic peptide"
SARNRRKR

SEQ ID NO: 3471 - protein, 21 aa, Artificial Sequence
  source: /note="Description of Artificial Sequence: Synthetic peptide"
GSGEGRGSLLTCGDVEENPGP

SEQ ID NO: 3472 - protein, 22 aa, Artificial Sequence
  source: /note="Description of Artificial Sequence: Synthetic peptide"
GSGATNFSLLKQAGDVEENPGP

SEQ ID NO: 3473 - protein, 23 aa, Artificial Sequence
  source: /note="Description of Artificial Sequence: Synthetic peptide"
GSGQCTNYALLKLAGDVESNPGP

SEQ ID NO: 3474 - protein, 25 aa, Artificial Sequence
  source: /note="Description of Artificial Sequence: Synthetic peptide"
GSGVKQTLNFDLLKLAGDVESNPGP

SEQ ID NO: 3475 - protein, 15 aa, Artificial Sequence
  source: /note="Description of Artificial Sequence: Synthetic Tag"
GLNDIFEAQKIEWHE

SEQ ID NO: 3476 - protein, 130 aa, Artificial Sequence
  source: /note="Description of Artificial Sequence: Synthetic Tag"
MLRKFKISIDGKEYLVEMEEISESSVPAATPITPTTENTRAASDQKQQSQTPSPAATASAANTMPAPMPGTILKVLVNVGDTVSENQPLMILEAMKMENEIVAGMAGTVSAIHVSSGQTVNAGDNLITIA

SEQ ID NO: 3477 - protein, 26 aa, Artificial Sequence
  source: /note="Description of Artificial Sequence: Synthetic Tag"
KRRWKKNFIAVSAANRFKKISSSGAL

SEQ ID NO: 3478 - protein, 50 aa, Artificial Sequence
  source: /note="Description of Artificial Sequence: Synthetic Tag"
TNPGVSAWQVNTAYTAQLVTYNGKTYKCLQPHTSLAGWEPSNVPALWQLQ

SEQ ID NO: 3479 - protein, 13 aa, Artificial Sequence
  source: /note="Description of Artificial Sequence: Synthetic Tag"
GAPVPYPDPLEPR

SEQ ID NO: 3480 - protein, 296 aa, Artificial Sequence
  source: /note="Description of Artificial Sequence: Synthetic Tag"
MLLWTAVLFLAPVAGTPAAPPKAVLKLEPQWINVLQEDSVTLTCRGTHSPESDSIQWFHNGNLIPTHTQPSYRFKANNNDSGEYTCQTGQTSLSDPVHLTVLSEWLVLQTPHLEFQEGETIVLRCHSWKDKPLVKVTFFQNGKSKKFSRSDPNFSIPQANHSHSGDYHCTGNIGYTLYSSKPVTITVQAPSSSPMGIIVAVVTGIAVAAIVAAVVALIYCRKKRISANSTDPVKAAQFEPPGRQMIAIRKRQPEETNNDYETADGGYMTLNPRAPTDDDKNIYLTLPPNDHVNSNN

SEQ ID NO: 3481 - protein, 8 aa, Artificial Sequence
  source: /note="Description of Artificial Sequence: Synthetic Tag"
DYKDDDDK

SEQ ID NO: 3482 - DNA, 24 bp, Artificial Sequence
  source: /note="Description of Artificial Sequence: Synthetic Tag"
gactacaaagacgatgacgacaag

SEQ ID NO: 3483 - DNA, 24 bp, Artificial Sequence
  source: /note="Description of Artificial Sequence: Synthetic Tag"
gactacaaggacgatgacgacaag

SEQ ID NO: 3484 - DNA, 24 bp, Artificial Sequence
  source: /note="Description of Artificial Sequence: Synthetic Tag"
gattataaagatgatgatgataaa

SEQ ID NO: 3485 - DNA, 24 bp, Artificial Sequence
  source: /note="Description of Artificial Sequence: Synthetic Tag"
gattataaagacgacgatgataag

SEQ ID NO: 3486 - protein, 238 aa, Artificial Sequence
  source: /note="Description of Artificial Sequence: Synthetic Tag"
MSKGEELFTGVVPILVELDGDVNGHKFSVSGEGEGDATYGKLTLKFICTTGKLPVPWPTLVTTFAYGVQCFSRYPDHMKRHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSVLSKDPNEKRDHMVLLEFVTAAGITHGMDELYK

SEQ ID NO: 3487 - protein, 239 aa, Artificial Sequence
  source: /note="Description of Artificial Sequence: Synthetic Tag"
MVSKGEELFTGVVPILVELDGDVNGHKFSVSGEGEGDATYGKLTLKFICTTGKLPVPWPTLVTTLTWGVQCFSRYPDHMKQHDFFKSAMPEGYVQERTIFFKDDGNYKTRAEVKFEGDTLVNRIELKGIDFKEDGNILGHKLEYNYISHNVYITADKQKNGIKANFKIRHNIEDGSVQLADHYQQNTPIGDGPVLLPDNHYLSTQSALSKDPNEKRDHMVLLEFVTAAGITLGMDELYK

SEQ ID NO: 3488 - protein, 225 aa, Artificial Sequence
  source: /note="Description of Artificial Sequence: Synthetic Tag"
MASSEDVIKEFMRFKVRMEGSVNGHEFEIEGEGEGRPYEGTQTAKLKVTKGGPLPFAWDILSPQFQYGSKAYVKHPADIPDYLKLSFPEGFKWERVMNFEDGGVVTVTQDSSLQDGEFIYKVKLRGTNFPSDGPVMQKKTMGWEASTERMYPEDGALKGEIKMRLKLKDGGHYDAEVKTTYMAKKPVQLPGAYKTDIKLDITSHNEDYTIVEQYERAEGRHSTGA

SEQ ID NO: 3489 - protein, 239 aa, Artificial Sequence
  source: /note="Description of Artificial Sequence: Synthetic Tag"
MVSKGEELFTGVVPILVELDGDVNGHKFSVSGEGEGDATYGKLTLKFICTTGKLPVPWPTLVTTFGYGLQCFARYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSYQSALSKDPNEKRDHMVLLEFVTAAGITLGMDELYK

SEQ ID NO: 3490 - protein, 201 aa, Artificial Sequence
  source: /note="Description of Artificial Sequence: Synthetic Tag"
MKLFYKPGACSLASHITLRESGKDFTLVSVDLMKKRLENGDNYFAVNPKGQVPALLLDDGTLLTEGVAIMQYLADSVPDRQLLAPVNSISRYKTIEWLNYIATELHKGFTPLFRPDTPEEYKSTVRAQLEKKLQYVNEALKDEHWICGQRFTIADAYLFTVLRWAYAVKLNLEGLEHIAAFMQRMAERPEVQDALSAEGLK

SEQ ID NO: 3491 - protein, 90 aa, Artificial Sequence
  source: /note="Description of Artificial Sequence: Synthetic Tag"
MVARTLSATTGELPSRGCSRRIVPISSASDGVHALVLHQRAIGSAGVDATAHYVSGPYRRETLVGTSHWIPDEEPEKLARLVLEHIAAHG

SEQ ID NO: 3492 - protein, 19 aa, Artificial Sequence
  source: /note="Description of Artificial Sequence: Synthetic Tag"
KDHLIHNVHKEFHAHAHNK

SEQ ID NO: 3493 - protein, 9 aa, Artificial Sequence
  source: /note="Description of Artificial Sequence: Synthetic Tag"
YPYDVPDYA

SEQ ID NO: 3494 - DNA, 27 bp, Artificial Sequence
  source: /note="Description of Artificial Sequence: Synthetic Tag"
tacccatacgatgttccagattacgct

SEQ ID NO: 3495 - DNA, 27 bp, Artificial Sequence
  source: /note="Description of Artificial Sequence: Synthetic Tag"
tatccttacgatgtgcccgactatgct

SEQ ID NO: 3496 - DNA, 27 bp, Artificial Sequence
  source: /note="Description of Artificial Sequence: Synthetic Tag"
tatccgtacgacgtaccagactacgca

SEQ ID NO: 3497 - protein, 16 aa, Artificial Sequence
  source: /note="Description of Artificial Sequence: Synthetic Tag"
TDKDMTITFTNKKDAE

SEQ ID NO: 3498 - protein, 396 aa, Artificial Sequence
  source: /note="Description of Artificial Sequence: Synthetic Tag"
MKIKTGARILALSALTTMMFSASALAKIEEGKLVIWINGDKGYNGLAEVGKKFEKDTGIKVTVEHPDKLEEKFPQVAATGDGPDIIFWAHDRFGGYAQSGLLAEITPDKAFQDKLYPFTWDAVRYNGKLIAYPIAVEALSLIYNKDLLPNPPKTWEEIPALDKELKAKGKSALMFNLQEPYFTWPLIAADGGYAFKYENGKYDIKDVGVDNAGAKAGLTFLVDLIKNKHMNADTDYSIAEAAFNKGETAMTINGPWAWSNIDTSKVNYGVTVLPTFKGQPSKPFVGVLSAGINAASPNKELAKEFLENYLLTDEGLEAVNKDKPLGAVALKSYEEELAKDPRIAATMENAQKGEIMPNIPQMSAFWYAVRTAVINAASGRQTVDEALKDAQTRITK

SEQ ID NO: 3499 - protein, 10 aa, Artificial Sequence
  source: /note="Description of Artificial Sequence: Synthetic Tag"
EQKLISEEDL

SEQ ID NO: 3500 - protein, 6 aa, Artificial Sequence
  source: /note="Description of Artificial Sequence: Synthetic Tag"
HHHHHH

SEQ ID NO: 3501 - protein, 5 aa, Artificial Sequence
  source: /note="Description of Artificial Sequence: Synthetic Tag"
RRRRR

SEQ ID NO: 3502 - protein, 6 aa, Artificial Sequence
  source: /note="Description of Artificial Sequence: Synthetic Tag"
EEEEEE

SEQ ID NO: 3503 - protein, 38 aa, Artificial Sequence
  source: /note="Description of Artificial Sequence: Synthetic Tag"
MDEKTTGWRGGHVVEGLAGELEQLRARLEHHPQGQREP

SEQ ID NO: 3504 - protein, 12 aa, Artificial Sequence
  source: /note="Description of Artificial Sequence: Synthetic Tag"
KLGDIEFIKVNK

SEQ ID NO: 3505 - protein, 13 aa, Artificial Sequence
  source: /note="Description of Artificial Sequence: Synthetic Tag"
SLAELLNAGLGGS

SEQ ID NO: 3506 - protein, 13 aa, Artificial Sequence
  source: /note="Description of Artificial Sequence: Synthetic Tag"
AHIVMVDAYKPTK

SEQ ID NO: 3507 - protein, 15 aa, Artificial Sequence
  source: /note="Description of Artificial Sequence: Synthetic Tag"
KETAAAKFERQHMDS

SEQ ID NO: 3508 - protein, 8 aa, Artificial Sequence
  source: /note="Description of Artificial Sequence: Synthetic Tag"
WSHPQFEK

SEQ ID NO: 3509 - protein, 6 aa, Artificial Sequence
  source: /note="Description of Artificial Sequence: Synthetic Tag"
CCPGCC

SEQ ID NO: 3510 - protein, 139 aa, Artificial Sequence
  source: /note="Description of Artificial Sequence: Synthetic Tag"
MNTVCTHCQAINRIPDDRIEDAAKCGRCGHDLFDGEVINATGETLDKLLKDDLPVVIDFWAPWCGPCRNFAPIFEDVAQERSGKVRFVKVNTEAERELSSRFGIRSIPTIMIFKNGQVVDMLNGAVPKAPFDSWLNESL

SEQ ID NO: 3511 - protein, 14 aa, Artificial Sequence
  source: /note="Description of Artificial Sequence: Synthetic Tag"
GKPIPNPLLGLDST

SEQ ID NO: 3512 - DNA, 42 bp, Artificial Sequence
  source: /note="Description of Artificial Sequence: Synthetic Tag"
ggtaagcctatccctaaccctctcctcggtctcgattctacg

SEQ ID NO: 3513 - protein, 11 aa, Artificial Sequence
  source: /note="Description of Artificial Sequence: Synthetic Tag"
YTDIEMNRLGK

SEQ ID NO: 3514 - protein, 8 aa, Artificial Sequence
  source: /note="Description of Artificial Sequence: Synthetic Tag"
DLYDDDDK

SEQ ID NO: 3515 - DNA, 28 bp, Artificial Sequence
  source: /note="Description of Artificial Sequence: Synthetic Spacer"
tctagataatacgactcactagagatcc

SEQ ID NO: 3516 - DNA, 16 bp, Artificial Sequence
  source: /note="Description of Artificial Sequence: Synthetic Spacer"
tatggccacaaccatg

SEQ ID NO: 3517 - DNA, 30 bp, Artificial Sequence
  source: /note="Description of Artificial Sequence: Synthetic Spacer"
aatctagataatacgactcactagagatcc

SEQ ID NO: 3518 - DNA, 9 bp, Artificial Sequence
  source: /note="Description of Artificial Sequence: Synthetic Spacer"
tcgcgaatg

SEQ ID NO: 3519 - DNA, 6 bp, Artificial Sequence
  source: /note="Description of Artificial Sequence: Synthetic Spacer"
tcgcga

SEQ ID NO: 3520 - DNA, 32 bp, Artificial Sequence
  source: /note="Description of Artificial Sequence: Synthetic Spacer"
gcttgccacaacccacaaggagacgaccttcc

SEQ ID NO: 3521 - DNA, 11 bp, Artificial Sequence
  source: /note="Description of Artificial Sequence: Synthetic Spacer"
atcgggctagc

SEQ ID NO: 3522 - protein, 4 aa, Artificial Sequence
  source: /note="Description of Artificial Sequence: Synthetic Linker"
GGGG

SEQ ID NO: 3523 - protein, 6 aa, Artificial Sequence
  source: /note="Description of Artificial Sequence: Synthetic Linker"
GGGGGG

SEQ ID NO: 3524 - protein, 8 aa, Artificial Sequence
  source: /note="Description of Artificial Sequence: Synthetic Linker"
GGGGGGGG

SEQ ID NO: 3525 - protein, 4 aa, Artificial Sequence
  source: /note="Description of Artificial Sequence: Synthetic Linker"
GGGS

SEQ ID NO: 3526 - protein, 5 aa, Artificial Sequence
  source: /note="Description of Artificial Sequence: Synthetic Linker"
GGGGS

SEQ ID NO: 3527 - protein, 10 aa, Artificial Sequence
  source: /note="Description of Artificial Sequence: Synthetic Linker"
GGGGSGGGGS

SEQ ID NO: 3528 - protein, 15 aa, Artificial Sequence
  source: /note="Description of Artificial Sequence: Synthetic Linker"
GGGGSGGGGSGGGGS

SEQ ID NO: 3529 - DNA, 45 bp, Artificial Sequence
  source: /note="Description of Artificial Sequence: Synthetic Linker"
ggaggaggaggatccggaggaggaggatctggcggcggcggcagc

SEQ ID NO: 3530 - DNA, 45 bp, Artificial Sequence
  source: /note="Description of Artificial Sequence: Synthetic Linker"
ggaggaggaggatccggaggaggaggatctggcggaggaggcagc

SEQ ID NO: 3531 - DNA, 45 bp, Artificial Sequence
  source: /note="Description of Artificial Sequence: Synthetic Linker"
ggaggaggaggaagcggaggaggaggatccggcggaggaggctct

SEQ ID NO: 3532 - DNA, 45 bp, Artificial Sequence
  source: /note="Description of Artificial Sequence: Synthetic Linker"
ggaggaggaggcagcggaggaggaggttctggaggaggcggcagc

SEQ ID NO: 3533 - DNA, 45 bp, Artificial Sequence
  source: /note="Description of Artificial Sequence: Synthetic Linker"
ggcggcggcggctctggaggaggaggcagcggcggaggaggctcc

SEQ ID NO: 3534 - DNA, 45 bp, Artificial Sequence
  source: /note="Description of Artificial Sequence: Synthetic Linker"
ggaggaggaggcagcggcggaggaggctccggcggcggcggctct

SEQ ID NO: 3535 - protein, 20 aa, Artificial Sequence
  source: /note="Description of Artificial Sequence: Synthetic Linker"
GGGGSGGGGSGGGGSGGGGS

SEQ ID NO: 3536 - protein, 36 aa, Artificial Sequence
  source: /note="Description of Artificial Sequence: Synthetic Linker"
GGSGGGSEGGGSEGGGSEGGGSEGGGSEGGGSGGGS

SEQ ID NO: 3537 - protein, 5 aa, Artificial Sequence
  source: /note="Description of Artificial Sequence: Synthetic Linker"
SSSSG

SEQ ID NO: 3538 - protein, 10 aa, Artificial Sequence
  source: /note="Description of Artificial Sequence: Synthetic Linker"
SSSSGSSSSG

SEQ ID NO: 3539 - protein, 13 aa, Artificial Sequence
  source: /note="Description of Artificial Sequence: Synthetic Linker"
SGSSSSGSSSSGS

SEQ ID NO: 3540 - protein, 15 aa, Artificial Sequence
  source: /note="Description of Artificial Sequence: Synthetic Linker"
SSSSGSSSSGSSSSG

SEQ ID NO: 3541 - protein, 19 aa, Artificial Sequence
  source: /note="Description of Artificial Sequence: Synthetic Linker"
SVTVSSSGSSSSGSSSSGS

SEQ ID NO: 3542 - protein, 20 aa, Artificial Sequence
  source: /note="Description of Artificial Sequence: Synthetic Linker"
SSSSGSSSSGSSSSGSSSSG

SEQ ID NO: 3543 - protein, 25 aa, Artificial Sequence
  source: /note="Description of Artificial Sequence: Synthetic Linker"
SSSSGSSSSGSSSSGSSSSGSSSSG

SEQ ID NO: 3544 - protein, 6 aa, Artificial Sequence
  source: /note="Description of Artificial Sequence: Synthetic Linker"
EFSTEF

SEQ ID NO: 3545 - DNA, 18 bp, Artificial Sequence
  source: /note="Description of Artificial Sequence: Synthetic Linker"
gagttctccaccgagttc

SEQ ID NO: 3546 - DNA, 18 bp, Artificial Sequence
  source: /note="Description of Artificial Sequence: Synthetic Linker"
gagttcagcaccgagttt

SEQ ID NO: 3547 - protein, 5 aa, Artificial Sequence
  source: /note="Description of Artificial Sequence: Synthetic Linker"
GGSGG

SEQ ID NO: 3548 - DNA, 15 bp, Artificial Sequence
  source: /note="Description of Artificial Sequence: Synthetic Linker"
ggaggcagcggagga

SEQ ID NO: 3549 - DNA, 15 bp, Artificial Sequence
  source: /note="Description of Artificial Sequence: Synthetic Linker"
ggaggctctggagga

SEQ ID NO: 3550 - DNA, 15 bp, Artificial Sequence
  source: /note="Description of Artificial Sequence: Synthetic Linker"
ggaggctccggcgga

SEQ ID NO: 3551 - DNA, 15 bp, Artificial Sequence
  source: /note="Description of Artificial Sequence: Synthetic Linker"
ggaggatccggaggc

SEQ ID NO: 3552 - DNA, 15 bp, Artificial Sequence
  source: /note="Description of Artificial Sequence: Synthetic Linker"
ggaggatctggagga

SEQ ID NO: 3553 - DNA, 15 bp, Artificial Sequence
  source: /note="Description of Artificial Sequence: Synthetic Linker"
ggtggatccggagga

SEQ ID NO: 3554 - protein, 4 aa, Artificial Sequence
  source: /note="Description of Artificial Sequence: Synthetic Linker"
GGSG

SEQ ID NO: 3555 - DNA, 12 bp, Artificial Sequence
  source: /note="Description of Artificial Sequence: Synthetic Linker"
ggaggatctgga

SEQ ID NO: 3556 - DNA, 12 bp, Artificial Sequence
  source: /note="Description of Artificial Sequence: Synthetic Linker"
ggtggatccgga

SEQ ID NO: 3557 - DNA, 18 bp, Artificial Sequence
  source: /note="Description of Artificial Sequence: Synthetic Linker"
ggtggctctggtggtggt

SEQ ID NO: 3558 - DNA, 18 bp, Artificial Sequence
  source: /note="Description of Artificial Sequence: Synthetic Linker"
ggaggtagtggtggaggc

SEQ ID NO: 3559 - protein, 6 aa, Artificial Sequence
  source: /note="Description of Artificial Sequence: Synthetic Linker"
GGSGGG

SEQ ID NO: 3560 - protein, 26 aa, Artificial Sequence
  source: /note="Description of Artificial Sequence: Synthetic Linker"
SGGGSGGGGSGGGGSGGGGSGGGSLQ

SEQ ID NO: 3561 - DNA, 78 bp, Artificial Sequence
  source: /note="Description of Artificial Sequence: Synthetic Linker"
tcaggtggcggtagtggtgggggaggatctggaggcggaggaagcgggggtggaggttcaggaggagggagcttgcaa

SEQ ID NO: 3562 - DNA, 78 bp, Artificial Sequence
  source: /note="Description of Artificial Sequence: Synthetic Linker"
tcaggtggcggtagtggtgggggaggatctggaggcggaggaagcgggggtggaggttcaggtggaggcagcttgcaa

SEQ ID NO: 3563 - DNA, 78 bp, Artificial Sequence
  source: /note="Description of Artificial Sequence: Synthetic Linker"
tccggtggaggtagcggtggagggggttctggtggaggaggttctggaggtggaggttctggcggtgggtccttgcaa

SEQ ID NO: 3564 - DNA, 78 bp, Artificial Sequence
  source: /note="Description of Artificial Sequence: Synthetic Linker"
tctggcggaggaagcggaggcggaggatctggtggtggtggatctggcggcggtggtagtggcggaggttctctgcaa

SEQ ID NO: 3565 - DNA, 78 bp, Artificial Sequence
  source: /note="Description of Artificial Sequence: Synthetic Linker"
tccggggggggtagcgggggagggggttccggcgggggagggtctggagggggaggttccggcggggggtccttgcaa

SEQ ID NO: 3566 - DNA, 78 bp, Artificial Sequence
  source: /note="Description of Artificial Sequence: Synthetic Linker"
tctggcggaggatctggaggaggcggatctggaggaggaggcagtggaggcggaggatctggcggaggatctctgcag

SEQ ID NO: 3567 - protein, 5 aa, Artificial Sequence
  source: /note="Description of Artificial Sequence: Synthetic Linker"
SGGGS

SEQ ID NO: 3568 - DNA, 15 bp, Artificial Sequence
  source: /note="Description of Artificial Sequence: Synthetic Linker"
tcaggtggcggtagt

SEQ ID NO: 3569 - DNA, 15 bp, Artificial Sequence
  source: /note="Description of Artificial Sequence: Synthetic Linker"
agcggcggtggcagc

SEQ ID NO: 3570 - DNA, 15 bp, Artificial Sequence
  source: /note="Description of Artificial Sequence: Synthetic Linker"
tcaggcggggggagt

SEQ ID NO: 3571 - protein, 20 aa, Artificial Sequence
  source: /note="Description of Artificial Sequence: Synthetic Linker"
SGGGSGGGGSGGGGSGGGGS

SEQ ID NO: 3572 - DNA, 60 bp, Artificial Sequence
  source: /note="Description of Artificial Sequence: Synthetic Linker"
agtggtggcgggtccggcggtggtggtagcgggggtggaggctcaggtggcggtggcagt

SEQ ID NO: 3573 - protein, 9 aa, Artificial Sequence
  source: /note="Description of Artificial Sequence: Synthetic Linker"
GGSGGGSGG

SEQ ID NO: 3574 - DNA, 27 bp, Artificial Sequence
  source: /note="Description of Artificial Sequence: Synthetic Linker"
ggaggtagtggtggaggcagtggtgga

SEQ ID NO: 3575 - protein, 5 aa, Artificial Sequence
  source: /note="Description of Artificial Sequence: Synthetic Linker"
GGGGG

SEQ ID NO: 3576 - protein, 25 aa, Artificial Sequence
  source: /note="Description of Artificial Sequence: Synthetic Linker"
GGGGSGGGGSGGGGSGGGGSGGGGS

SEQ ID NO: 3577 - protein, 30 aa, Artificial Sequence
  source: /note="Description of Artificial Sequence: Synthetic Linker"
GGGGSGGGGSGGGGSGGGGSGGGGSGGGGS

SEQ ID NO: 3578 - protein, 10 aa, Artificial Sequence
  source: /note="Description of Artificial Sequence: Synthetic Linker"
SSSSGSSSSG

SEQ ID NO: 3579 - protein, 30 aa, Artificial Sequence
  source: /note="Description of Artificial Sequence: Synthetic Linker"
SSSSGSSSSGSSSSGSSSSGSSSSGSSSSG

SEQ ID NO: 3580 - protein, 34 aa, Artificial Sequence
  source: /note="Description of Artificial Sequence: Synthetic Linker"
SGGGSGGGGSGGGGSGGGGSGGGGSGGGGSGGGS

SEQ ID NO: 3581 - DNA, 102 bp, Artificial Sequence
  source: /note="Description of Artificial Sequence: Synthetic Linker"
tctggtggcgggagtggaggaggtgggtccggagggggagggagcggtggtggaggttccggcggggggggtagtggaggcggagggtcaggtgggggcagc

SEQ ID NO: 3582 - protein, 36 aa, Artificial Sequence
  source: /note="Description of Artificial Sequence: Synthetic Linker"
GGSAGGSGSGSSGGSSGASGTGTAGGTGSGSGTGSG

SEQ ID NO: 3583 - protein, 5 aa, Artificial Sequence
  source: /note="Description of Artificial Sequence: Synthetic Linker"
PAPAP

SEQ ID NO: 3584 - protein, 10 aa, Artificial Sequence
  source: /note="Description of Artificial Sequence: Synthetic Linker"
APAPAPAPAP

SEQ ID NO: 3585 - protein, 12 aa, Artificial Sequence
  source: /note="Description of Artificial Sequence: Synthetic Linker"
APAPAPAPAPAP

SEQ ID NO: 3586 - protein, 14 aa, Artificial Sequence
  source: /note="Description of Artificial Sequence: Synthetic Linker"
APAPAPAPAPAPAP

SEQ ID NO: 3587 - protein, 16 aa, Artificial Sequence
  source: /note="Description of Artificial Sequence: Synthetic Linker"
APAPAPAPAPAPAPAP

SEQ ID NO: 3588 - protein, 18 aa, Artificial Sequence
  source: /note="Description of Artificial Sequence: Synthetic Linker"
APAPAPAPAPAPAPAPAP

SEQ ID NO: 3589 - protein, 20 aa, Artificial Sequence
  source: /note="Description of Artificial Sequence: Synthetic Linker"
APAPAPAPAPAPAPAPAPAP

SEQ ID NO: 3590 - protein, 22 aa, Artificial Sequence
  source: /note="Description of Artificial Sequence: Synthetic Linker"
APAPAPAPAPAPAPAPAPAPAP

SEQ ID NO: 3591 - protein, 24 aa, Artificial Sequence
  source: /note="Description of Artificial Sequence: Synthetic Linker"
APAPAPAPAPAPAPAPAPAPAPAP

SEQ ID NO: 3592 - protein, 26 aa, Artificial Sequence
  source: /note="Description of Artificial Sequence: Synthetic Linker"
APAPAPAPAPAPAPAPAPAPAPAPAP

SEQ ID NO: 3593 - protein, 28 aa, Artificial Sequence
  source: /note="Description of Artificial Sequence: Synthetic Linker"
APAPAPAPAPAPAPAPAPAPAPAPAPAP

SEQ ID NO: 3594 - protein, 30 aa, Artificial Sequence
  source: /note="Description of Artificial Sequence: Synthetic Linker"
APAPAPAPAPAPAPAPAPAPAPAPAPAPAP

SEQ ID NO: 3595 - protein, 32 aa, Artificial Sequence
  source: /note="Description of Artificial Sequence: Synthetic Linker"
APAPAPAPAPAPAPAPAPAPAPAPAPAPAPAP

SEQ ID NO: 3596 - protein, 33 aa, Artificial Sequence
  source: /note="Description of Artificial Sequence: Synthetic Linker"
EPEPEPEPIPEPPKEAPVVIEKPKPKPKPKPKP

SEQ ID NO: 3597 - protein, 34 aa, Artificial Sequence
  source: /note="Description of Artificial Sequence: Synthetic Linker"
APAPAPAPAPAPAPAPAPAPAPAPAPAPAPAPAP

SEQ ID NO: 3598 - protein, 5 aa, Artificial Sequence
  source: /note="Description of Artificial Sequence: Synthetic Linker"
EAAAK

SEQ ID NO: 3599 - protein, 10 aa, Artificial Sequence
  source: /note="Description of Artificial Sequence: Synthetic Linker"
EAAAKEAAAK

SEQ ID NO: 3600 - protein, 12 aa, Artificial Sequence
  source: /note="Description of Artificial Sequence: Synthetic Linker"
AEAAAKEAAAKA

SEQ ID NO: 3601 - protein, 15 aa, Artificial Sequence
  source: /note="Description of Artificial Sequence: Synthetic Linker"
EAAAKEAAAKEAAAK

SEQ ID NO: 3602 - protein, 17 aa, Artificial Sequence
  source: /note="Description of Artificial Sequence: Synthetic Linker"
AEAAAKEAAAKEAAAKA

SEQ ID NO: 3603 - protein, 22 aa, Artificial Sequence
  source: /note="Description of Artificial Sequence: Synthetic Linker"
AEAAAKEAAAKEAAAKEAAAKA

SEQ ID NO: 3604 - protein, 27 aa, Artificial Sequence
  source: /note="Description of Artificial Sequence: Synthetic Linker"
AEAAAKEAAAKEAAAKEAAAKEAAAKA

SEQ ID NO: 3605 - protein, 46 aa, Artificial Sequence
  source: /note="Description of Artificial Sequence: Synthetic Linker"
AEAAAKEAAAKEAAAKEAAAKALEAEAAAKEAAAKEAAAKEAAAKA

SEQ ID NO: 3606 - protein, 12 aa, Artificial Sequence
  source: /note="Description of Artificial Sequence: Synthetic Linker"
GKSSGSGSESKS

SEQ ID NO: 3607 - protein, 15 aa, Artificial Sequence
  source: /note="Description of Artificial Sequence: Synthetic Linker"
GGSTSGSGKSSEGKG

SEQ ID NO: 3608 - protein, 19 aa, Artificial Sequence
  source: /note="Description of Artificial Sequence: Synthetic Linker"
GSTSGSGKSSSEGSGSTKG

SEQ ID NO: 3609 - protein, 13 aa, Artificial Sequence
  source: /note="Description of Artificial Sequence: Synthetic Linker"
VDYPYDVPDYALD

SEQ ID NO: 3610 - DNA, 39 bp, Artificial Sequence
  source: /note="Description of Artificial Sequence: Synthetic Linker"
gtcgactatccctacgatgttccggactacgcactggac

SEQ ID NO: 3611 - protein, 14 aa, Artificial Sequence
  source: /note="Description of Artificial Sequence: Synthetic Linker"
EGKSSGSGSESKEF

SEQ ID NO: 3612 - protein, 35 aa, Artificial Sequence
  source: /note="Description of Artificial Sequence: Synthetic Linker"
SGGGSGGGGSGGGGSGGGGSGGGSLQYPYDVPDYA

SEQ ID NO: 3613 - DNA, 105 bp, Artificial Sequence
  source: /note="Description of Artificial Sequence: Synthetic Linker"
tcaggtggcggtagtggtgggggaggatctggaggcggaggaagcgggggtggaggttcaggtggaggcagcttgcaatacccatacgatgttccagattacgct

SEQ ID NO: 3614 - protein, 8 aa, Artificial Sequence
  source: /note="Description of Artificial Sequence: Synthetic Linker"
DYKDDDDK

SEQ ID NO: 3615 - DNA, 24 bp, Artificial Sequence
  source: /note="Description of Artificial Sequence: Synthetic Linker"
gactacaaagacgatgacgacaag

SEQ ID NO: 3616 - protein, 34 aa, Artificial Sequence
  source: /note="Description of Artificial Sequence: Synthetic Linker"
SGGGSGGGGSGGGGSGGGGSYPYDVPDYASGGGS

SEQ ID NO: 3617 - DNA, 102 bp, Artificial Sequence
  source: /note="Description of Artificial Sequence: Synthetic Linker"
agtggtggcgggtccggcggtggtggtagcgggggtggaggctcaggtggcggtggcagttatccttacgatgtgcccgactatgcttcaggcggggggagt

SEQ ID NO: 3618 - protein, 22 aa, Artificial Sequence
  source: /note="Description of Artificial Sequence: Synthetic Linker"
GSGATNFSLLKQAGDVEENPGP

SEQ ID NO: 3619 - DNA, 66 bp, Artificial Sequence
  source: /note="Description of Artificial Sequence: Synthetic Linker"
ggttcaggagctactaacttcagcctgctgaagcaggctggagacgtggaggagaaccctggacct

SEQ ID NO: 3620 - protein, 8 aa, Artificial Sequence
  source: /note="Description of Artificial Sequence: Synthetic Linker"
  MOD_RES (4)..(4): Any amino acid
DVEXNPGP

SEQ ID NO: 3621 - protein, 8 aa, Artificial Sequence
  source: /note="Description of Artificial Sequence: Synthetic Linker"
  MOD_RES (4)..(4): Any amino acid
DIEXNPGP

SEQ ID NO: 3622 - protein, 22 aa, Artificial Sequence
  source: /note="Description of Artificial Sequence: Synthetic Linker"
SGGGGSGGGGSGGGGSGGGSLQ

SEQ ID NO: 3623 - protein, 13 aa, Artificial Sequence
  source: /note="Description of Artificial Sequence: Synthetic Linker"
QLIGMLQGLMRDL

SEQ ID NO: 3624 - DNA, 39 bp, Artificial Sequence
  source: /note="Description of Artificial Sequence: Synthetic Linker"
cagctgatagggatgctacaaggcctgatgcgtgacctg

SEQ ID NO: 3625 - protein, 4 aa, Artificial Sequence
  source: /note="Description of Artificial Sequence: Synthetic Linker"
ASFE

SEQ ID NO: 3626 - DNA, 12 bp, Artificial Sequence
  source: /note="Description of Artificial Sequence: Synthetic Linker"
gctagcttcgaa

SEQ ID NO: 3627 - protein, 6 aa, Artificial Sequence
  source: /note="Description of Artificial Sequence: Synthetic Linker"
ATKASK

SEQ ID NO: 3628 - protein, 7 aa, Artificial Sequence
  source: /note="Description of Artificial Sequence: Synthetic Linker"
ATKGATK

SEQ ID NO: 3629 - protein, 7 aa, Artificial Sequence
  source: /note="Description of Artificial Sequence: Synthetic Linker"
IAKAFKN

SEQ ID NO: 3630 - protein, 14 aa, Artificial Sequence
  source: /note="Description of Artificial Sequence: Synthetic Linker"
VRGSPAINVAVHVF

SEQ ID NO: 3631 - protein, 18 aa, Artificial Sequence
  source: /note="Description of Artificial Sequence: Synthetic Linker"
GSTSGSGKPGSGEGSTKG

SEQ ID NO: 3632 - protein, 18 aa, Artificial Sequence
  source: /note="Description of Artificial Sequence: Synthetic Linker"
KESGSVSSEQLAQFRSLD

SEQ ID NO: 3633 - protein, 4 aa, Artificial Sequence
  source: /note="Description of Artificial Sequence: Synthetic Linker"
GFLG

SEQ ID NO: 3634 - protein, 6 aa, Artificial Sequence
  source: /note="Description of Artificial Sequence: Synthetic Linker"
PLGLWA

SEQ ID NO: 3635 - protein, 6 aa, Artificial Sequence
  source: /note="Description of Artificial Sequence: Synthetic Linker"
RVLAEA

SEQ ID NO: 3636 - protein, 8 aa, Artificial Sequence
  source: /note="Description of Artificial Sequence: Synthetic Linker"
GGIEGRGS

SEQ ID NO: 3637 - protein, 9 aa, Artificial Sequence
  source: /note="Description of Artificial Sequence: Synthetic Linker"
RRRRRRRRR

SEQ ID NO: 3638 - protein, 10 aa, Artificial Sequence
  source: /note="Description of Artificial Sequence: Synthetic Linker"
EDVVCCSMSY

SEQ ID NO: 3639 - protein, 10 aa, Artificial Sequence
  source: /note="Description of Artificial Sequence: Synthetic Linker"
TRHRQPRGWE

SEQ ID NO: 3640 - protein, 10 aa, Artificial Sequence
  source: /note="Description of Artificial Sequence: Synthetic Linker"
AGNRVRRSVG

SEQ ID NO: 3641 - protein, 12 aa, Artificial Sequence
  source: /note="Description of Artificial Sequence: Synthetic Linker"
CRRRRRREAEAC

SEQ ID NO: 3642 - protein, 17 aa, Artificial Sequence
  source: /note="Description of Artificial Sequence: Synthetic Linker"
VSQTSKLTRAETVFPDV

SEQ ID NO: 3643 - protein, 20 aa, Artificial Sequence
  source: /note="Description of Artificial Sequence: Synthetic Linker"
LEAGCKNFFPRSFTSCGSLE

SEQ ID NO: 3644 - protein, 12 aa, Artificial Sequence
  source: /note="Description of Artificial Sequence: Synthetic Linker"
GSAGSAAGSGEF

SEQ ID NO: 3645 - protein, 14 aa, Artificial Sequence
  source: /note="Description of Artificial Sequence: Synthetic Linker"
EGKSSGSGSESKST

SEQ ID NO: 3646 - protein, 20 aa, Artificial Sequence
  source: /note="Description of Artificial Sequence: Synthetic Linker"
NSGAGSGGSSGSDGASGSRD

SEQ ID NO: 3647 - protein, 8 aa, Artificial Sequence
  source: /note="Description of Artificial Sequence: Synthetic Linker"
LWSLDTTP

SEQ ID NO: 3648 - protein, 4 aa, Artificial Sequence
  source: /note="Description of Artificial Sequence: Synthetic Linker"
MDGA

SEQ ID NO: 3649 - protein, 4 aa, Artificial Sequence
  source: /note="Description of Artificial Sequence: Synthetic Linker"
QGNY

SEQ ID NO: 3650 - protein, 4 aa, Artificial Sequence
  source: /note="Description of Artificial Sequence: Synthetic Linker"
RDGK

SEQ ID NO: 3651 - protein, 5 aa, Artificial Sequence
  source: /note="Description of Artificial Sequence: Synthetic Linker"
DLNVG

SEQ ID NO: 3652 - protein, 5 aa, Artificial Sequence
  source: /note="Description of Artificial Sequence: Synthetic Linker"
MATDE

SEQ ID NO: 3653 - protein, 6 aa, Artificial Sequence
  source: /note="Description of Artificial Sequence: Synthetic Linker"
LTGSGA

SEQ ID NO: 3654 - protein, 7 aa, Artificial Sequence
  source: /note="Description of Artificial Sequence: Synthetic Linker"
FAASGEL

SEQ ID NO: 3655 - protein, 7 aa, Artificial Sequence
  source: /note="Description of Artificial Sequence: Synthetic Linker"
FNNREEQ

SEQ ID NO: 3656 - protein, 7 aa, Artificial Sequence
  source: /note="Description of Artificial Sequence: Synthetic Linker"
GYMARNE

SEQ ID NO: 3657 - protein, 7 aa, Artificial Sequence
  source: /note="Description of Artificial Sequence: Synthetic Linker"
VGTEHAK

SEQ ID NO: 3658 - protein, 5 aa, Artificial Sequence
  source: /note="Description of Artificial Sequence: Synthetic Linker"
LNLDY

SEQ ID NO: 3659 - protein, 14 aa, Artificial Sequence
  source: /note="Description of Artificial Sequence: Synthetic Linker"
KDGVIKGYYAYINP

SEQ ID NO: 3660 - protein, 4 aa, Artificial Sequence
  source: /note="Description of Artificial Sequence: Synthetic Linker"
SKAQ

SEQ ID NO: 3661 - protein, 6 aa, Artificial Sequence
  source: /note="Description of Artificial Sequence: Synthetic Linker"
LFNASA

SEQ ID NO: 3662 - protein, 6 aa, Artificial Sequence
  source: /note="Description of Artificial Sequence: Synthetic Linker"
YQDGSV

SEQ ID NO: 3663 - protein, 7 aa, Artificial Sequence
  source: /note="Description of Artificial Sequence: Synthetic Linker"
IHPQSVI

SEQ ID NO: 3664 - protein, 5 aa, Artificial Sequence
  source: /note="Description of Artificial Sequence: Synthetic Linker"
KNPMD

SEQ ID NO: 3665 - protein, 7 aa, Artificial Sequence
  source: /note="Description of Artificial Sequence: Synthetic Linker"
LGSEVPL

SEQ ID NO: 3666 - protein, 14 aa, Artificial Sequence
  source: /note="Description of Artificial Sequence: Synthetic Linker"
LNVNNKVPNGATSM

SEQ ID NO: 3667 - protein, 5 aa, Artificial Sequence
  source: /note="Description of Artificial Sequence: Synthetic Linker"
TTDDL

SEQ ID NO: 3668 - protein, 6 aa, Artificial Sequence
  source: /note="Description of Artificial Sequence: Synthetic Linker"
AAGIRA

SEQ ID NO: 3669 - protein, 6 aa, Artificial Sequence
  source: /note="Description of Artificial Sequence: Synthetic Linker"
QAGVDC

SEQ ID NO: 3670 - protein, 6 aa, Artificial Sequence
  source: /note="Description of Artificial Sequence: Synthetic Linker"
YNPTDI

SEQ ID NO: 3671 - protein, 8 aa, Artificial Sequence
  source: /note="Description of Artificial Sequence: Synthetic Linker"
EFLPRDTG

SEQ ID NO: 3672 - protein, 9 aa, Artificial Sequence
  source: /note="Description of Artificial Sequence: Synthetic Linker"
GSGLPEQTD

SEQ ID NO: 3673 - protein, 5 aa, Artificial Sequence
  source: /note="Description of Artificial Sequence: Synthetic Linker"
YSSNV

SEQ ID NO: 3674 - protein, 6 aa, Artificial Sequence
  source: /note="Description of Artificial Sequence: Synthetic Linker"
KAGLNP

SEQ ID NO: 3675 - protein, 6 aa, Artificial Sequence
  source: /note="Description of Artificial Sequence: Synthetic Linker"
KEEGKF

SEQ ID NO: 3676 - protein, 6 aa, Artificial Sequence
  source: /note="Description of Artificial Sequence: Synthetic Linker"
VRGGIW

SEQ ID NO: 3677 - protein, 9 aa, Artificial Sequence
  source: /note="Description of Artificial Sequence: Synthetic Linker"
QRYLKPENK

SEQ ID NO: 3678 - protein, 6 aa, Artificial Sequence
  source: /note="Description of Artificial Sequence: Synthetic Linker"
EGVGEI

SEQ ID NO: 3679 - protein, 8 aa, Artificial Sequence
  source: /note="Description of Artificial Sequence: Synthetic Linker"
PVDPPEKW

SEQ ID NO: 3680 - protein, 9 aa, Artificial Sequence
  source: /note="Description of Artificial Sequence: Synthetic Linker"
AHPGVSIPT

SEQ ID NO: 3681 - protein, 15 aa, Artificial Sequence
  source: /note="Description of Artificial Sequence: Synthetic Linker"
FKDPELPRNTPKRSI

SEQ ID NO: 3682 - protein, 14 aa, Artificial Sequence
  source: /note="Description of Artificial Sequence: Synthetic Linker"
YLEGVERNPVGAGL

SEQ ID NO: 3683 - protein, 5 aa, Artificial Sequence
  source: /note="Description of Artificial Sequence: Synthetic Linker"
CPRCP

SEQ ID NO: 3684 - protein, 7 aa, Artificial Sequence
  source: /note="Description of Artificial Sequence: Synthetic Linker"
APPVAGP

SEQ ID NO: 3685 - protein, 8 aa, Artificial Sequence
  source: /note="Description of Artificial Sequence: Synthetic Linker"
APELLGGP

SEQ ID NO: 3686 - protein, 9 aa, Artificial Sequence
  source: /note="Description of Artificial Sequence: Synthetic Linker"
CCVECPPCP

SEQ ID NO: 3687 - protein, 12 aa, Artificial Sequence
  source: /note="Description of Artificial Sequence: Synthetic Linker"
ELKTPLGDTTHT

SEQ ID NO: 3688 - protein, 6 aa, Artificial Sequence
  source: /note="Description of Artificial Sequence: Synthetic Linker"
HNVDDV

SEQ ID NO: 3689 - protein, 6 aa, Artificial Sequence
  source: /note="Description of Artificial Sequence: Synthetic Linker"
AGQKDE

SEQ ID NO: 3690 - protein, 9 aa, Artificial Sequence
  source: /note="Description of Artificial Sequence: Synthetic Linker"
KLNLPILPT

SEQ ID NO: 3691 - protein, 9 aa, Artificial Sequence
  source: /note="Description of Artificial Sequence: Synthetic Linker"
SSPRVTNEG

SEQ ID NO: 3692 - protein, 17 aa, Artificial Sequence
  source: /note="Description of Artificial Sequence: Synthetic Linker"
KAAAALKGSDHRRATNV

SEQ ID NO: 3693 - protein, 4 aa, Artificial Sequence
  source: /note="Description of Artificial Sequence: Synthetic Linker"
KKRV

SEQ ID NO: 3694 - protein, 5 aa, Artificial Sequence
  source: /note="Description of Artificial Sequence: Synthetic Linker"
QLEVK

SEQ ID NO: 3695 - protein, 5 aa, Artificial Sequence
  source: /note="Description of Artificial Sequence: Synthetic Linker"
TNGRL

SEQ ID NO: 3696 - protein, 10 aa, Artificial Sequence
  source: /note="Description of Artificial Sequence: Synthetic Linker"
LYTPEIAENQ

SEQ ID NO: 3697 - protein, 4 aa, Artificial Sequence
  source: /note="Description of Artificial Sequence: Synthetic Linker"
NSEY

SEQ ID NO: 3698 - protein, 5 aa, Artificial Sequence
  source: /note="Description of Artificial Sequence: Synthetic Linker"
SMKDF

SEQ ID NO: 3699 - protein, 12 aa, Artificial Sequence
  source: /note="Description of Artificial Sequence: Synthetic Linker"
KDRWQERHILRP

SEQ ID NO: 3700 - protein, 14 aa, Artificial Sequence
  source: /note="Description of Artificial Sequence: Synthetic Linker"
DDPEGPVMPGSHSV

SEQ ID NO: 3701 - protein, 23 aa, Artificial Sequence
  source: /note="Description of Artificial Sequence: Synthetic Linker"
LCPSNPTCIYKYGDESSNSLPGH

SEQ ID NO: 3702 - protein, 35 aa, Artificial Sequence
  source: /note="Description of Artificial Sequence: Synthetic Linker"
LCEALQHNLPPFTPPPHTEDSVYPMPRVIFRMFDY

SEQ ID NO: 3703 - protein, 5 aa, Artificial Sequence
  source: /note="Description of Artificial Sequence: Synthetic Linker"
NMVTC

SEQ ID NO: 3704 - protein, 10 aa, Artificial Sequence
  source: /note="Description of Artificial Sequence: Synthetic Linker"
NLEEHLGKLN

SEQ ID NO: 3705 - protein, 4 aa, Artificial Sequence
  source: /note="Description of Artificial Sequence: Synthetic Linker"
QGAH

SEQ ID NO: 3706 - protein, 6 aa, Artificial Sequence
  source: /note="Description of Artificial Sequence: Synthetic Linker"
QRIPLY

SEQ ID NO: 3707 - protein, 8 aa, Artificial Sequence
  source: /note="Description of Artificial Sequence: Synthetic Linker"
QRKPLFYI

SEQ ID NO: 3708 - protein, 4 aa, Artificial Sequence
  source: /note="Description of Artificial Sequence: Synthetic Linker"
AGGR

SEQ ID NO: 3709 - protein, 6 aa, Artificial Sequence
  source: /note="Description of Artificial Sequence: Synthetic Linker"
YPYKGE

SEQ ID NO: 3710 - protein, 7 aa, Artificial Sequence
  source: /note="Description of Artificial Sequence: Synthetic Linker"
NHETGEL

SEQ ID NO: 3711 - protein, 8 aa, Artificial Sequence
  source: /note="Description of Artificial Sequence: Synthetic Linker"
TFELKTDV

SEQ ID NO: 3712 - protein, 25 aa, Artificial Sequence
  source: /note="Description of Artificial Sequence: Synthetic Linker"
ALGLPHSDVFRQAKDVAESDRGFSL

SEQ ID NO: 3713 - protein, 4 aa, Artificial Sequence
  source: /note="Description of Artificial Sequence: Synthetic Linker"
LKDW

SEQ ID NO: 3714 - protein, 4 aa, Artificial Sequence
  source: /note="Description of Artificial Sequence: Synthetic Linker"
WTGM

SEQ ID NO: 3715 - protein, 4 aa, Artificial Sequence
  source: /note="Description of Artificial Sequence: Synthetic Linker"
YNGL

SEQ ID NO: 3716 - protein, 5 aa, Artificial Sequence
  source: /note="Description of Artificial Sequence: Synthetic Linker"
DRPGE

SEQ ID NO: 3717 - protein, 5 aa, Artificial Sequence
  source: /note="Description of Artificial Sequence: Synthetic Linker"
LGVSI

SEQ ID NO: 3718 - protein, 5 aa, Artificial Sequence
  source: /note="Description of Artificial Sequence: Synthetic Linker"
RSTGR

SEQ ID NO: 3719 - protein, 5 aa, Artificial Sequence
  source: /note="Description of Artificial Sequence: Synthetic Linker"
YRMLP

SEQ ID NO: 3720 - protein, 5 aa, Artificial Sequence
  source: /note="Description of Artificial Sequence: Synthetic Linker"
YVNDF

SEQ ID NO: 3721 - protein, 6 aa, Artificial Sequence
  source: /note="Description of Artificial Sequence: Synthetic Linker"
EYGSPR

SEQ ID NO: 3722 - protein, 6 aa, Artificial Sequence
  source: /note="Description of Artificial Sequence: Synthetic Linker"
IDRGRV

SEQ ID NO: 3723 - protein, 7 aa, Artificial Sequence
  source: /note="Description of Artificial Sequence: Synthetic Linker"
RAADGQM

SEQ ID NO: 3724 - protein, 7 aa, Artificial Sequence
  source: /note="Description of Artificial Sequence: Synthetic Linker"
TKEKNNV

SEQ ID NO: 3725 - protein, 8 aa, Artificial Sequence
  source: /note="Description of Artificial Sequence: Synthetic Linker"
DQAGLGHE

SEQ ID NO: 3726 - protein, 8 aa, Artificial Sequence
  source: /note="Description of Artificial Sequence: Synthetic Linker"
FSQIKDAM

SEQ ID NO: 3727 - protein, 8 aa, Artificial Sequence
  source: /note="Description of Artificial Sequence: Synthetic Linker"
QAAPGKST

SEQ ID NO: 3728 - protein, 8 aa, Artificial Sequence
  source: /note="Description of Artificial Sequence: Synthetic Linker"
QLPAGATQ

SEQ ID NO: 3729 - protein, 9 aa, Artificial Sequence
  source: /note="Description of Artificial Sequence: Synthetic Linker"
AAKHPDMLT

SEQ ID NO: 3730 - protein, 9 aa, Artificial Sequence
  source: /note="Description of Artificial Sequence: Synthetic Linker"
LASKLPTGV

SEQ ID NO: 3731 - protein, 9 aa, Artificial Sequence
  source: /note="Description of Artificial Sequence: Synthetic Linker"
PNGLEDTPQ

SEQ ID NO: 3732 - protein, 9 aa, Artificial Sequence
  source: /note="Description of Artificial Sequence: Synthetic Linker"
QERLSGNQA

SEQ ID NO: 3733 - protein, 12 aa, Artificial Sequence
  source: /note="Description of Artificial Sequence: Synthetic Linker"
NGFGFAGRGQNT

SEQ ID NO: 3734 - protein, 14 aa, Artificial Sequence
  source: /note="Description of Artificial Sequence: Synthetic Linker"
RLPSSFLPDEDQGV

SEQ ID NO: 3735 - protein, 15 aa, Artificial Sequence
  source: /note="Description of Artificial Sequence: Synthetic Linker"
FNLPAIVELGTATGF

SEQ ID NO: 3736 - protein, 17 aa, Artificial Sequence
  source: /note="Description of Artificial Sequence: Synthetic Linker"
MLKPIAKGDHGEGKKGF

SEQ ID NO: 3737 - protein, 7 aa, Artificial Sequence
  source: /note="Description of Artificial Sequence: Synthetic Linker"
LAHLLPP

SEQ ID NO: 3738 - protein, 9 aa, Artificial Sequence
  source: /note="Description of Artificial Sequence: Synthetic Linker"
QAPEAGFEH

SEQ ID NO: 3739 - protein, 10 aa, Artificial Sequence
  source: /note="Description of Artificial Sequence: Synthetic Linker"
KDKFICDRPL

SEQ ID NO: 3740 - protein, 16 aa, Artificial Sequence
  source: /note="Description of Artificial Sequence: Synthetic Linker"
PVEFHNPLKGHVAEPH

SEQ ID NO: 3741 - protein, 16 aa, Artificial Sequence
  source: /note="Description of Artificial Sequence: Synthetic Linker"
QKTMPSAPAPDGLPSE

SEQ ID NO: 3742 - protein, 4 aa, Artificial Sequence
  source: /note="Description of Artificial Sequence: Synthetic Linker"
AGRV

SEQ ID NO: 3743 - protein, 6 aa, Artificial Sequence
  source: /note="Description of Artificial Sequence: Synthetic Linker"
AGHGFA

SEQ ID NO: 3744 - protein, 10 aa, Artificial Sequence
  source: /note="Description of Artificial Sequence: Synthetic Linker"
LPPGPGPFPG

SEQ ID NO: 3745 - protein, 11 aa, Artificial Sequence
  source: /note="Description of Artificial Sequence: Synthetic Linker"
IFGIGGGLLEY

SEQ ID NO: 3746 - protein, 15 aa, Artificial Sequence
  source: /note="Description of Artificial Sequence: Synthetic Linker"
AYYNFEDLPNNMDNI

SEQ ID NO: 3747 - protein, 10 aa, Artificial Sequence
  source: /note="Description of Artificial Sequence: Synthetic Linker"
MICTRSKPKC

SEQ ID NO: 3748 - protein, 6 aa, Artificial Sequence
  source: /note="Description of Artificial Sequence: Synthetic Linker"
QSSLDL

SEQ ID NO: 3749 - protein, 6 aa, Artificial Sequence
  source: /note="Description of Artificial Sequence: Synthetic Linker"
IPDGDE

SEQ ID NO: 3750 - protein, 15 aa, Artificial Sequence
  source: /note="Description of Artificial Sequence: Synthetic Linker"
PTNPVTGEIPTLSAL

SEQ ID NO: 3751 - protein, 9 aa, Artificial Sequence
  source: /note="Description of Artificial Sequence: Synthetic Linker"
GGPCRADIK

SEQ ID NO: 3752 - protein, 11 aa, Artificial Sequence
  source: /note="Description of Artificial Sequence: Synthetic Linker"
SGACSTDKPCG

SEQ ID NO: 3753 - protein, 11 aa, Artificial Sequence
  source: /note="Description of Artificial Sequence: Synthetic Linker"
EGSKTVPIADK

SEQ ID NO: 3754 - protein, 7 aa, Artificial Sequence
  source: /note="Description of Artificial Sequence: Synthetic Linker"
INGKKPE

SEQ ID NO: 3755 - protein, 8 aa, Artificial Sequence
  source: /note="Description of Artificial Sequence: Synthetic Linker"
ELPAYMSG

SEQ ID NO: 3756 - protein, 8 aa, Artificial Sequence
  source: /note="Description of Artificial Sequence: Synthetic Linker"
VTGTLDYG

SEQ ID NO: 3757 - protein, 15 aa, Artificial Sequence
  source: /note="Description of Artificial Sequence: Synthetic Linker"
AAEDAIEIHPGTPNV

SEQ ID NO: 3758 - protein, 21 aa, Artificial Sequence
  source: /note="Description of Artificial Sequence: Synthetic Linker"
LEFKMPADGRIWGSKYPRPTA

SEQ ID NO: 3759 - protein, 5 aa, Artificial Sequence
  source: /note="Description of Artificial Sequence: Synthetic Linker"
SDYDV

SEQ ID NO: 3760 - protein, 5 aa, Artificial Sequence
  source: /note="Description of Artificial Sequence: Synthetic Linker"
VGSGP

SEQ ID NO: 3761 - protein, 6 aa, Artificial Sequence
  source: /note="Description of Artificial Sequence: Synthetic Linker"
IDSQSA

SEQ ID NO: 3762 - protein, 6 aa, Artificial Sequence
  source: /note="Description of Artificial Sequence: Synthetic Linker"
NKRDAY

SEQ ID NO: 3763 - protein, 6 aa, Artificial Sequence
  source: /note="Description of Artificial Sequence: Synthetic Linker"
RKGIRT

SEQ ID NO: 3764 - protein, 7 aa, Artificial Sequence
  source: /note="Description of Artificial Sequence: Synthetic Linker"
MGERFGG

SEQ ID NO: 3765 - protein, 8 aa, Artificial Sequence
  source: /note="Description of Artificial Sequence: Synthetic Linker"
VDTGAEKR

SEQ ID NO: 3766 - protein, 10 aa, Artificial Sequence
  source: /note="Description of Artificial Sequence: Synthetic Linker"
TGGHPSKEAQ

SEQ ID NO: 3767 - protein, 10 aa, Artificial Sequence
  source: /note="Description of Artificial Sequence: Synthetic Linker"
VPAATEGGLH

SEQ ID NO: 3768 - protein, 18 aa, Artificial Sequence
  source: /note="Description of Artificial Sequence: Synthetic Linker"
VLDTVDIENYISVPKTEG

SEQ ID NO: 3769 - protein, 5 aa, Artificial Sequence
  source: /note="Description of Artificial Sequence: Synthetic Linker"
DLAYV

SEQ ID NO: 3770 - protein, 13 aa, Artificial Sequence
  source: /note="Description of Artificial Sequence: Synthetic Linker"
VVPPELKTKDHII

SEQ ID NO: 3771 - protein, 5 aa, Artificial Sequence
  source: /note="Description of Artificial Sequence: Synthetic Linker"
WKQHK

SEQ ID NO: 3772 - protein, 7 aa, Artificial Sequence
  source: /note="Description of Artificial Sequence: Synthetic Linker"
KIQGCSA

SEQ ID NO: 3773 - protein, 8 aa, Artificial Sequence
  source: /note="Description of Artificial Sequence: Synthetic Linker"
DVASGDGL

SEQ ID NO: 3774 - protein, 20 aa, Artificial Sequence
  source: /note="Description of Artificial Sequence: Synthetic Linker"
VSPWHRMSYFFNPVSNFISF

SEQ ID NO: 3775 - protein, 5 aa, Artificial Sequence
  source: /note="Description of Artificial Sequence: Synthetic Linker"
YDNDE

SEQ ID NO: 3776 - protein, 10 aa, Artificial Sequence
  source: /note="Description of Artificial Sequence: Synthetic Linker"
RNGDSRRPGL

SEQ ID NO: 3777 - protein, 4 aa, Artificial Sequence
  source: /note="Description of Artificial Sequence: Synthetic Linker"
VEET

SEQ ID NO: 3778 - protein, 6 aa, Artificial Sequence
  source: /note="Description of Artificial Sequence: Synthetic Linker"
AIQDIS

SEQ ID NO: 3779 - protein, 6 aa, Artificial Sequence
  source: /note="Description of Artificial Sequence: Synthetic Linker"
KLPITL

SEQ ID NO: 3780 - protein, 11 aa, Artificial Sequence
  source: /note="Description of Artificial Sequence: Synthetic Linker"
ADSAYITYAND

SEQ ID NO: 3781 - protein, 4 aa, Artificial Sequence
  source: /note="Description of Artificial Sequence: Synthetic Linker"
FGGV

SEQ ID NO: 3782 - protein, 4 aa, Artificial Sequence
  source: /note="Description of Artificial Sequence: Synthetic Linker"
YGIK

SEQ ID NO: 3783 - protein, 5 aa, Artificial Sequence
  source: /note="Description of Artificial Sequence: Synthetic Linker"
INFNS

SEQ ID NO: 3784 - protein, 5 aa, Artificial Sequence
  source: /note="Description of Artificial Sequence: Synthetic Linker"
YGRDH

SEQ ID NO: 3785 - protein, 6 aa, Artificial Sequence
  source: /note="Description of Artificial Sequence: Synthetic Linker"
GMSRTN

SEQ ID NO: 3786 - protein, 7 aa, Artificial Sequence
  source: /note="Description of Artificial Sequence: Synthetic Linker"
ASLGING

SEQ ID NO: 3787 - protein, 7 aa, Artificial Sequence
  source: /note="Description of Artificial Sequence: Synthetic Linker"
SAPRLQH

SEQ ID NO: 3788 - protein, 7 aa, Artificial Sequence
  source: /note="Description of Artificial Sequence: Synthetic Linker"
YIPDFGG

SEQ ID NO: 3789 - protein, 8 aa, Artificial Sequence
  source: /note="Description of Artificial Sequence: Synthetic Linker"
SLPNYLAP

SEQ ID NO: 3790 - protein, 9 aa, Artificial Sequence
  source: /note="Description of Artificial Sequence: Synthetic Linker"
LDGKFADNV

SEQ ID NO: 3791 - protein, 9 aa, Artificial Sequence
  source: /note="Description of Artificial Sequence: Synthetic Linker"
VINNVNADP

SEQ ID NO: 3792 - protein, 10 aa, Artificial Sequence
  source: /note="Description of Artificial Sequence: Synthetic Linker"
QTQHALEKLS

SEQ ID NO: 3793 - protein, 11 aa, Artificial Sequence
  source: /note="Description of Artificial Sequence: Synthetic Linker"
EGKVFKTRHTG

SEQ ID NO: 3794 - protein, 11 aa, Artificial Sequence
  source: /note="Description of Artificial Sequence: Synthetic Linker"
VKADSEGQPGP

SEQ ID NO: 3795 - protein, 12 aa, Artificial Sequence
  source: /note="Description of Artificial Sequence: Synthetic Linker"
RAFVYHPDIEDR

SEQ ID NO: 3796 - protein, 13 aa, Artificial Sequence
  source: /note="Description of Artificial Sequence: Synthetic Linker"
AFGDVDTADPLDP

SEQ ID NO: 3797 - protein, 13 aa, Artificial Sequence
  source: /note="Description of Artificial Sequence: Synthetic Linker"
LKTETHARGEGST

SEQ ID NO: 3798 - protein, 16 aa, Artificial Sequence
  source: /note="Description of Artificial Sequence: Synthetic Linker"
KNGPIDFQPREPFSAL

SEQ ID NO: 3799 - protein, 16 aa, Artificial Sequence
  source: /note="Description of Artificial Sequence: Synthetic Linker"
VINPGTDRNWTGHPFV

SEQ ID NO: 3800 - protein, 17 aa, Artificial Sequence
  source: /note="Description of Artificial Sequence: Synthetic Linker"
QITQEYFGFATHLAYQG

SEQ ID NO: 3801 - protein, 22 aa, Artificial Sequence
  source: /note="Description of Artificial Sequence: Synthetic Linker"
NHWDNLNRVVERGYAGLSLWDW

SEQ ID NO: 3802 - protein, 15 aa, Artificial Sequence
  source: /note="Description of Artificial Sequence: Synthetic Linker"
VGSLVSGPSFTSGEV

SEQ ID NO: 3803 - protein, 13 aa, Artificial Sequence
  source: /note="Description of Artificial Sequence: Synthetic Linker"
ITSQETDGWYTLA

SEQ ID NO: 3804 - protein, 21 aa, Artificial Sequence
  source: /note="Description of Artificial Sequence: Synthetic Linker"
RNKEGQDVNEQGQPIRGRTQD

SEQ ID NO: 3805 - protein, 5 aa, Artificial Sequence
  source: /note="Description of Artificial Sequence: Synthetic Linker"
HFQPF

SEQ ID NO: 3806 - protein, 5 aa, Artificial Sequence
  source: /note="Description of Artificial Sequence: Synthetic Linker"
TGTPV

SEQ ID NO: 3807 - protein, 7 aa, Artificial Sequence
  source: /note="Description of Artificial Sequence: Synthetic Linker"
PLSHFDA

SEQ ID NO: 3808 - protein, 4 aa, Artificial Sequence
  source: /note="Description of Artificial Sequence: Synthetic Linker"
FNPI

SEQ ID NO: 3809 - protein, 4 aa, Artificial Sequence
  source: /note="Description of Artificial Sequence: Synthetic Linker"
KNGS

SEQ ID NO: 3810 - protein, 5 aa, Artificial Sequence
  source: /note="Description of Artificial Sequence: Synthetic Linker"
DRFQG

SEQ ID NO: 3811 - protein, 5 aa, Artificial Sequence
  source: /note="Description of Artificial Sequence: Synthetic Linker"
EVPDI

SEQ ID NO: 3812 - protein, 6 aa, Artificial Sequence
  source: /note="Description of Artificial Sequence: Synthetic Linker"
ACELHT

SEQ ID NO: 3813 - protein, 6 aa, Artificial Sequence
  source: /note="Description of Artificial Sequence: Synthetic Linker"
LPATLT

SEQ ID NO: 3814 - protein, 6 aa, Artificial Sequence
  source: /note="Description of Artificial Sequence: Synthetic Linker"
LPDPYG

SEQ ID NO: 3815 - protein, 6 aa, Artificial Sequence
  source: /note="Description of Artificial Sequence: Synthetic Linker"
LPHAQP

SEQ ID NO: 3816 - protein, 6 aa, Artificial Sequence
  source: /note="Description of Artificial Sequence: Synthetic Linker"
RQQASF

SEQ ID NO: 3817 - protein, 6 aa, Artificial Sequence
  source: /note="Description of Artificial Sequence: Synthetic Linker"
YIGGNL

SEQ ID NO: 3818 - protein, 7 aa, Artificial Sequence
  source: /note="Description of Artificial Sequence: Synthetic Linker"
FGRTCKE

SEQ ID NO: 3819 - protein, 7 aa, Artificial Sequence
  source: /note="Description of Artificial Sequence: Synthetic Linker"
VDKGDNV

SEQ ID NO: 3820 - protein, 7 aa, Artificial Sequence
  source: /note="Description of Artificial Sequence: Synthetic Linker"
WGPECNH

SEQ ID NO: 3821 - protein, 8 aa, Artificial Sequence
  source: /note="Description of Artificial Sequence: Synthetic Linker"
VRRCEAQK

SEQ ID NO: 3822 - protein, 9 aa, Artificial Sequence
  source: /note="Description of Artificial Sequence: Synthetic Linker"
KVLIKEEDA

SEQ ID NO: 3823 - protein, 9 aa, Artificial Sequence
  source: /note="Description of Artificial Sequence: Synthetic Linker"
SCATGWKGL

SEQ ID NO: 3824 - protein, 10 aa, Artificial Sequence
  source: /note="Description of Artificial Sequence: Synthetic Linker"
IVDLPDHIEV

SEQ ID NO: 3825 - protein, 10 aa, Artificial Sequence
  source: /note="Description of Artificial Sequence: Synthetic Linker"
LCTACMNNGV

SEQ ID NO: 3826 - protein, 13 aa, Artificial Sequence
  source: /note="Description of Artificial Sequence: Synthetic Linker"
RCSGQEGCKSYVF

SEQ ID NO: 3827 - protein, 22 aa, Artificial Sequence
  source: /note="Description of Artificial Sequence: Synthetic Linker"
LCSPGWQGLQCEREGIPRMTPK

SEQ ID NO: 3828 - protein, 25 aa, Artificial Sequence
  source: /note="Description of Artificial Sequence: Synthetic Linker"
CNEACHPGFYGPDCKLRCSCNNGEM

SEQ ID NO: 3829 - protein, 4 aa, Artificial Sequence
  source: /note="Description of Artificial Sequence: Synthetic Linker"
LKTP

SEQ ID NO: 3830 - protein, 14 aa, Artificial Sequence
  source: /note="Description of Artificial Sequence: Synthetic Linker"
AKGRRAEDGSVIDY

SEQ ID NO: 3831 - protein, 12 aa, Artificial Sequence
  source: /note="Description of Artificial Sequence: Synthetic Linker"
AARPLRVHRRPL

SEQ ID NO: 3832 - protein, 4 aa, Artificial Sequence
  source: /note="Description of Artificial Sequence: Synthetic Linker"
LIPL

SEQ ID NO: 3833 - protein, 5 aa, Artificial Sequence
  source: /note="Description of Artificial Sequence: Synthetic Linker"
FGEGA

SEQ ID NO: 3834 - protein, 6 aa, Artificial Sequence
  source: /note="Description of Artificial Sequence: Synthetic Linker"
AFDDAK

SEQ ID NO: 3835 - protein, 6 aa, Artificial Sequence
  source: /note="Description of Artificial Sequence: Synthetic Linker"
KVNGKR

SEQ ID NO: 3836 - protein, 7 aa, Artificial Sequence
  source: /note="Description of Artificial Sequence: Synthetic Linker"
LSKTGMP

SEQ ID NO: 3837 - protein, 8 aa, Artificial Sequence
  source: /note="Description of Artificial Sequence: Synthetic Linker"
VLPYPRMR

SEQ ID NO: 3838 - protein, 8 aa, Artificial Sequence
  source: /note="Description of Artificial Sequence: Synthetic Linker"
VRADDGLL

SEQ ID NO: 3839 - protein, 16 aa, Artificial Sequence
  source: /note="Description of Artificial Sequence: Synthetic Linker"
EAEDDFKIEKPTKEDA

SEQ ID NO: 3840 - protein, 5 aa, Artificial Sequence
  source: /note="Description of Artificial Sequence: Synthetic Linker"
IRFGR

SEQ ID NO: 3841 - protein, 6 aa, Artificial Sequence
  source: /note="Description of Artificial Sequence: Synthetic Linker"
QTETHV

SEQ ID NO: 3842 - protein, 13 aa, Artificial Sequence
  source: /note="Description of Artificial Sequence: Synthetic Linker"
PLKGRYTPSVGDV

SEQ ID NO: 3843 - protein, 7 aa, Artificial Sequence
  source: /note="Description of Artificial Sequence: Synthetic Linker"
KNPALSD

SEQ ID NO: 3844 - protein, 12 aa, Artificial Sequence
  source: /note="Description of Artificial Sequence: Synthetic Linker"
RFGSSEIGKGKK

SEQ ID NO: 3845 - protein, 14 aa, Artificial Sequence
  source: /note="Description of Artificial Sequence: Synthetic Linker"
GKFSGRKGTWVGFT

SEQ ID NO: 3846 - protein, 9 aa, Artificial Sequence
  source: /note="Description of Artificial Sequence: Synthetic Linker"
QFFMSDKPL

SEQ ID NO: 3847 - protein, 11 aa, Artificial Sequence
  source: /note="Description of Artificial Sequence: Synthetic Linker"
HAPRDMGPQPR

SEQ ID NO: 3848 - protein, 12 aa, Artificial Sequence
  source: /note="Description of Artificial Sequence: Synthetic Linker"
HFKPAPWNGLPA

SEQ ID NO: 3849 - protein, 6 aa, Artificial Sequence
  source: /note="Description of Artificial Sequence: Synthetic Linker"
LDPPKQ

SEQ ID NO: 3850 - protein, 6 aa, Artificial Sequence
  source: /note="Description of Artificial Sequence: Synthetic Linker"
TATADD

SEQ ID NO: 3851 - protein, 7 aa, Artificial Sequence
  source: /note="Description of Artificial Sequence: Synthetic Linker"
AEAQTCR

SEQ ID NO: 3852 - protein, 7 aa, Artificial Sequence
  source: /note="Description of Artificial Sequence: Synthetic Linker"
EEKPQGQ

SEQ ID NO: 3853 - protein, 7 aa, Artificial Sequence
  source: /note="Description of Artificial Sequence: Synthetic Linker"
LGLNDPL

SEQ ID NO: 3854 - protein, 7 aa, Artificial Sequence
  source: /note="Description of Artificial Sequence: Synthetic Linker"
RFPTLPF

SEQ ID NO: 3855 - protein, 9 aa, Artificial Sequence
  source: /note="Description of Artificial Sequence: Synthetic Linker"
ISSFDRPNI

SEQ ID NO: 3856 - protein, 13 aa, Artificial Sequence
  source: /note="Description of Artificial Sequence: Synthetic Linker"
YFGEGRQEPCGNC

SEQ ID NO: 3857 - protein, 7 aa, Artificial Sequence
  source: /note="Description of Artificial Sequence: Synthetic Linker"
LGLNRKW

SEQ ID NO: 3858 - protein, 12 aa, Artificial Sequence
  source: /note="Description of Artificial Sequence: Synthetic Linker"
YFGSYGTRGVGY

SEQ ID NO: 3859 - protein, 4 aa, Artificial Sequence
  source: /note="Description of Artificial Sequence: Synthetic Linker"
NIKG

SEQ ID NO: 3860 - protein, 5 aa, Artificial Sequence
  source: /note="Description of Artificial Sequence: Synthetic Linker"
NPVPQ

SEQ ID NO: 3861 - protein, 6 aa, Artificial Sequence
  source: /note="Description of Artificial Sequence: Synthetic Linker"
AKFPAD

SEQ ID NO: 3862 - protein, 6 aa, Artificial Sequence
  source: /note="Description of Artificial Sequence: Synthetic Linker"
IQNVDF

SEQ ID NO: 3863 - protein, 6 aa, Artificial Sequence
  source: /note="Description of Artificial Sequence: Synthetic Linker"
LTGQMV

SEQ ID NO: 3864 - protein, 8 aa, Artificial Sequence
  source: /note="Description of Artificial Sequence: Synthetic Linker"
AAEDARQY

SEQ ID NO: 3865 - protein, 16 aa, Artificial Sequence
  source: /note="Description of Artificial Sequence: Synthetic Linker"
KLDGSQTSKWLSSEPL

SEQ ID NO: 3866 - protein, 4 aa, Artificial Sequence
  source: /note="Description of Artificial Sequence: Synthetic Linker"
DIFK

SEQ ID NO: 3867 - protein, 4 aa, Artificial Sequence
  source: /note="Description of Artificial Sequence: Synthetic Linker"
LPGM

SEQ ID NO: 3868 - protein, 6 aa, Artificial Sequence
  source: /note="Description of Artificial Sequence: Synthetic Linker"
IPGNGG

SEQ ID NO: 3869 - protein, 6 aa, Artificial Sequence
  source: /note="Description of Artificial Sequence: Synthetic Linker"
VEDWVE

SEQ ID NO: 3870 - protein, 15 aa, Artificial Sequence
  source: /note="Description of Artificial Sequence: Synthetic Linker"
RLKADETYTSPEDYF

SEQ ID NO: 3871 - protein, 5 aa, Artificial Sequence
  source: /note="Description of Artificial Sequence: Synthetic Linker"
RKPTE

SEQ ID NO: 3872 - protein, 6 aa, Artificial Sequence
  source: /note="Description of Artificial Sequence: Synthetic Linker"
YARTIV

SEQ ID NO: 3873 - protein, 4 aa, Artificial Sequence
  source: /note="Description of Artificial Sequence: Synthetic Linker"
REDG

SEQ ID NO: 3874 - protein, 4 aa, Artificial Sequence
  source: /note="Description of Artificial Sequence: Synthetic Linker"
YKTL

SEQ ID NO: 3875 - protein, 6 aa, Artificial Sequence
  source: /note="Description of Artificial Sequence: Synthetic Linker"
DRAKRI

SEQ ID NO: 3876 - protein, 11 aa, Artificial Sequence
  source: /note="Description of Artificial Sequence: Synthetic Linker"
KAPQTEPPASI

SEQ ID NO: 3877 - protein, 21 aa, Artificial Sequence
  source: /note="Description of Artificial Sequence: Synthetic Linker"
AAQSDRPAHAQGVPLTRIERT

SEQ ID NO: 3878 - protein, 8 aa, Artificial Sequence
  source: /note="Description of Artificial Sequence: Synthetic Linker"
DWDKDADP

SEQ ID NO: 3879 - protein, 14 aa, Artificial Sequence
  source: /note="Description of Artificial Sequence: Synthetic Linker"
LFDRHVSSSVRLND

SEQ ID NO: 3880 - protein, 26 aa, Artificial Sequence
  source: /note="Description of Artificial Sequence: Synthetic Linker"
LVEESSRQLPTAAPEPAKVDQDAGRL

SEQ ID NO: 3881 - protein, 6 aa, Artificial Sequence
  source: /note="Description of Artificial Sequence: Synthetic Linker"
LLGVTP

SEQ ID NO: 3882 - protein, 4 aa, Artificial Sequence
  source: /note="Description of Artificial Sequence: Synthetic Linker"
DTLP

SEQ ID NO: 3883 - protein, 4 aa, Artificial Sequence
  source: /note="Description of Artificial Sequence: Synthetic Linker"
ENGL

SEQ ID NO: 3884 - protein, 4 aa, Artificial Sequence
  source: /note="Description of Artificial Sequence: Synthetic Linker"
FREV

SEQ ID NO: 3885 - protein, 4 aa, Artificial Sequence
  source: /note="Description of Artificial Sequence: Synthetic Linker"
KVSP

SEQ ID NO: 3886 - protein, 4 aa, Artificial Sequence
  source: /note="Description of Artificial Sequence: Synthetic Linker"
LDGK

SEQ ID NO: 3887 - protein, 4 aa, Artificial Sequence
  source: /note="Description of Artificial Sequence: Synthetic Linker"
LNGK

SEQ ID NO: 3888 - protein, 4 aa, Artificial Sequence
  source: /note="Description of Artificial Sequence: Synthetic Linker"
PLLI

SEQ ID NO: 3889 - protein, 4 aa, Artificial Sequence
  source: /note="Description of Artificial Sequence: Synthetic Linker"
SGQT

SEQ ID NO: 3890 - protein, 5 aa, Artificial Sequence
  source: /note="Description of Artificial Sequence: Synthetic Linker"
KNPRG

SEQ ID NO: 3891 - protein, 5 aa, Artificial Sequence
  source: /note="Description of Artificial Sequence: Synthetic Linker"
KPTTQ

SEQ ID NO: 3892 - protein, 5 aa, Artificial Sequence
  source: /note="Description of Artificial Sequence: Synthetic Linker"
SLKWK

SEQ ID NO: 3893 - protein, 5 aa, Artificial Sequence
  source: /note="Description of Artificial Sequence: Synthetic Linker"
TSEMD

SEQ ID NO: 3894 - protein, 6 aa, Artificial Sequence
  source: /note="Description of Artificial Sequence: Synthetic Linker"
LSGQEA

SEQ ID NO: 3895 - protein, 9 aa, Artificial Sequence
  source: /note="Description of Artificial Sequence: Synthetic Linker"
PLDVAPQGK

SEQ ID NO: 3896 - protein, 11 aa, Artificial Sequence
  source: /note="Description of Artificial Sequence: Synthetic Linker"
AKNTYDDSAWT

SEQ ID NO: 3897 - protein, 12 aa, Artificial Sequence
  source: /note="Description of Artificial Sequence: Synthetic Linker"
ELPELPQPESAG

SEQ ID NO: 3898 - protein, 12 aa, Artificial Sequence
  source: /note="Description of Artificial Sequence: Synthetic Linker"
QPNATAWSEAGH

SEQ ID NO: 3899 - protein, 12 aa, Artificial Sequence
  source: /note="Description of Artificial Sequence: Synthetic Linker"
SEYLFRHSDNEL

SEQ ID NO: 3900 - protein, 13 aa, Artificial Sequence
  source: /note="Description of Artificial Sequence: Synthetic Linker"
VAYTAPKVQLPSL

SEQ ID NO: 3901 - protein, 15 aa, Artificial Sequence
  source: /note="Description of Artificial Sequence: Synthetic Linker"
NLSVTLPAASHAIPH

SEQ ID NO: 3902 - protein, 16 aa, Artificial Sequence
  source: /note="Description of Artificial Sequence: Synthetic Linker"
IDNMGLDEDWTIGSED

SEQ ID NO: 3903 - protein, 23 aa, Artificial Sequence
  source: /note="Description of Artificial Sequence: Synthetic Linker"
TGNLGGENYRDTVRGPLNEGGLY

SEQ ID NO: 3904 - protein, 10 aa, Artificial Sequence
  source: /note="Description of Artificial Sequence: Synthetic Linker"
SNADLQTLPA

SEQ ID NO: 3905 - protein, 11 aa, Artificial Sequence
  source: /note="Description of Artificial Sequence: Synthetic Linker"
LRGKIVPTPMQ

SEQ ID NO: 3906 - protein, 12 aa, Artificial Sequence
  source: /note="Description of Artificial Sequence: Synthetic Linker"
KGGVAYRLPVPG

SEQ ID NO: 3907 - protein, 11 aa, Artificial Sequence
  source: /note="Description of Artificial Sequence: Synthetic Linker"
QAWATAPYAPT

SEQ ID NO: 3908 - protein, 7 aa, Artificial Sequence
  source: /note="Description of Artificial Sequence: Synthetic Linker"
YSKGVSQ

SEQ ID NO: 3909 - protein, 6 aa, Artificial Sequence
  source: /note="Description of Artificial Sequence: Synthetic Linker"
QKGRVL

SEQ ID NO: 3910 - protein, 6 aa, Artificial Sequence
  source: /note="Description of Artificial Sequence: Synthetic Linker"
VLGKEL

SEQ ID NO: 3911 - protein, 4 aa, Artificial Sequence
  source: /note="Description of Artificial Sequence: Synthetic Linker"
ANTP

SEQ ID NO: 3912 - protein, 4 aa, Artificial Sequence
  source: /note="Description of Artificial Sequence: Synthetic Linker"
DAPT

SEQ ID NO: 3913 - protein, 5 aa, Artificial Sequence
  source: /note="Description of Artificial Sequence: Synthetic Linker"
LDPIK

SEQ ID NO: 3914 - protein, 5 aa, Artificial Sequence
  source: /note="Description of Artificial Sequence: Synthetic Linker"
TTDFQ

SEQ ID NO: 3915 - protein, 6 aa, Artificial Sequence
  source: /note="Description of Artificial Sequence: Synthetic Linker"
PWNKEV

SEQ ID NO: 3916 - protein, 6 aa, Artificial Sequence
  source: /note="Description of Artificial Sequence: Synthetic Linker"
QQLLPP

SEQ ID NO: 3917 - protein, 8 aa, Artificial Sequence
  source: /note="Description of Artificial Sequence: Synthetic Linker"
TDPQTGKT

SEQ ID NO: 3918 - protein, 9 aa, Artificial Sequence
  source: /note="Description of Artificial Sequence: Synthetic Linker"
GRHGIVPTR

SEQ ID NO: 3919 - protein, 9 aa, Artificial Sequence
  source: /note="Description of Artificial Sequence: Synthetic Linker"
TADGSWFFK

SEQ ID NO: 3920 - protein, 12 aa, Artificial Sequence
  source: /note="Description of Artificial Sequence: Synthetic Linker"
LFSMGVTRGKWG

SEQ ID NO: 3921 - protein, 18 aa, Artificial Sequence
  source: /note="Description of Artificial Sequence: Synthetic Linker"
LAPGMGEDGELEETGVPA

SEQ ID NO: 3922 - protein, 21 aa, Artificial Sequence
  source: /note="Description of Artificial Sequence: Synthetic Linker"
CWVMHPGESWHGFKDIPDNWS

SEQ ID NO: 3923 - protein, 7 aa, Artificial Sequence
  source: /note="Description of Artificial Sequence: Synthetic Linker"
EVHVRGH

SEQ ID NO: 3924 - protein, 17 aa, Artificial Sequence
  source: /note="Description of Artificial Sequence: Synthetic Linker"
VGDPGPICRPWECCDKA

SEQ ID NO: 3925 - protein, 7 aa, Artificial Sequence
  source: /note="Description of Artificial Sequence: Synthetic Linker"
KYEIPEG

SEQ ID NO: 3926 - protein, 7 aa, Artificial Sequence
  source: /note="Description of Artificial Sequence: Synthetic Linker"
RKVCEQE

SEQ ID NO: 3927 - protein, 12 aa, Artificial Sequence
  source: /note="Description of Artificial Sequence: Synthetic Linker"
EQLLPKLFDGCY

SEQ ID NO: 3928 - protein, 5 aa, Artificial Sequence
  source: /note="Description of Artificial Sequence: Synthetic Linker"
SLHFS

SEQ ID NO: 3929 - protein, 6 aa, Artificial Sequence
  source: /note="Description of Artificial Sequence: Synthetic Linker"
VYPLQW

SEQ ID NO: 3930 - protein, 7 aa, Artificial Sequence
  source: /note="Description of Artificial Sequence: Synthetic Linker"
KTVSGLY

SEQ ID NO: 3931 - protein, 12 aa, Artificial Sequence
  source: /note="Description of Artificial Sequence: Synthetic Linker"
SDPAFQPPCSEV

SEQ ID NO: 3932 - protein, 13 aa, Artificial Sequence
  source: /note="Description of Artificial Sequence: Synthetic Linker"
SVVKPIGLAPLVY

SEQ ID NO: 3933 - protein, 30 aa, Artificial Sequence
  source: /note="Description of Artificial Sequence: Synthetic Linker"
ARWHSRLGFFRDPRPFPLPLSSLFSDGGNV

SEQ ID NO: 3934 - protein, 15 aa, Artificial Sequence
  source: /note="Description of Artificial Sequence: Synthetic Linker"
ELRSLTRHPKYKTEL

SEQ ID NO: 3935 - protein, 7 aa, Artificial Sequence
  source: /note="Description of Artificial Sequence: Synthetic Linker"
VYNTFCI

SEQ ID NO: 3936 - protein, 4 aa, Artificial Sequence
  source: /note="Description of Artificial Sequence: Synthetic Linker"
AATM

SEQ ID NO: 3937 - protein, 4 aa, Artificial Sequence
  source: /note="Description of Artificial Sequence: Synthetic Linker"
FAGT

SEQ ID NO: 3938 - protein, 4 aa, Artificial Sequence
  source: /note="Description of Artificial Sequence: Synthetic Linker"
RGDF

SEQ ID NO: 3939 - protein, 4 aa, Artificial Sequence
  source: /note="Description of Artificial Sequence: Synthetic Linker"
SNPW

SEQ ID NO: 3940 - protein, 4 aa, Artificial Sequence
  source: /note="Description of Artificial Sequence: Synthetic Linker"
SPDK

SEQ ID NO: 3941 - protein, 7 aa, Artificial Sequence
  source: /note="Description of Artificial Sequence: Synthetic Linker"
KTADQQD

SEQ ID NO: 3942 - protein, 8 aa, Artificial Sequence
  source: /note="Description of Artificial Sequence: Synthetic Linker"
QGAGAVDA

SEQ ID NO: 3943 - protein, 9 aa, Artificial Sequence
  source: /note="Description of Artificial Sequence: Synthetic Linker"
AKQDDDSHY

SEQ ID NO: 3944 - protein, 9 aa, Artificial Sequence
  source: /note="Description of Artificial Sequence: Synthetic Linker"
DKDNTSSKV

SEQ ID NO: 3945 - protein, 9 aa, Artificial Sequence
  source: /note="Description of Artificial Sequence: Synthetic Linker"
NLSALEKPI

SEQ ID NO: 3946 - protein, 11 aa, Artificial Sequence
  source: /note="Description of Artificial Sequence: Synthetic Linker"
IHRHANGKPYA

SEQ ID NO: 3947 - protein, 16 aa, Artificial Sequence
  source: /note="Description of Artificial Sequence: Synthetic Linker"
EGVENIEDIESSEITE

SEQ ID NO: 3948 - protein, 36 aa, Artificial Sequence
  source: /note="Description of Artificial Sequence: Synthetic Linker"
DSKDGSSYYHEANSDAKDQLDGDGLQFYALKNNFTA

SEQ ID NO: 3949 - protein, 9 aa, Artificial Sequence
  source: /note="Description of Artificial Sequence: Synthetic Linker"
GSIQGQDLS

SEQ ID NO: 3950 - protein, 4 aa, Artificial Sequence
  source: /note="Description of Artificial Sequence: Synthetic Linker"
RFDT

SEQ ID NO: 3951 - protein, 15 aa, Artificial Sequence
  source: /note="Description of Artificial Sequence: Synthetic Linker"
TLTTPASNQLLALPR

SEQ ID NO: 3952 - protein, 4 aa, Artificial Sequence
  source: /note="Description of Artificial Sequence: Synthetic Linker"
ELPF

SEQ ID NO: 3953 - protein, 7 aa, Artificial Sequence
  source: /note="Description of Artificial Sequence: Synthetic Linker"
AGDNPDA

SEQ ID NO: 3954 - protein, 7 aa, Artificial Sequence
  source: /note="Description of Artificial Sequence: Synthetic Linker"
VTTAEAY

SEQ ID NO: 3955 - protein, 11 aa, Artificial Sequence
  source: /note="Description of Artificial Sequence: Synthetic Linker"
AFPGLNGMDLA

SEQ ID NO: 3956 - protein, 18 aa, Artificial Sequence
  source: /note="Description of Artificial Sequence: Synthetic Linker"
WTQGSWTLTGGLPQAKKE

SEQ ID NO: 3957 - protein, 16 aa, Artificial Sequence
  source: /note="Description of Artificial Sequence: Synthetic Linker"
RGIKLTKIKLDLPINF

SEQ ID NO: 3958 - protein, 4 aa, Artificial Sequence
  source: /note="Description of Artificial Sequence: Synthetic Linker"
FLDV

SEQ ID NO: 3959 - protein, 5 aa, Artificial Sequence
  source: /note="Description of Artificial Sequence: Synthetic Linker"
QTSLS

SEQ ID NO: 3960 - protein, 26 aa, Artificial Sequence
  source: /note="Description of Artificial Sequence: Synthetic Linker"
YTGKWGLNDVNPEAWPRDLKGMAAVR

SEQ ID NO: 3961 - protein, 17 aa, Artificial Sequence
  source: /note="Description of Artificial Sequence: Synthetic Linker"
VKEGAGQPDFCDGHSPA

SEQ ID NO: 3962 - protein, 9 aa, Artificial Sequence
  source: /note="Description of Artificial Sequence: Synthetic Linker"
VDGSRGDGS

SEQ ID NO: 3963 - protein, 41 aa, Artificial Sequence
  source: /note="Description of Artificial Sequence: Synthetic Linker"
LKARVGSADDAKKDAAKKDDAKKDDAKKDGSQTNKAKNLVQ

SEQ ID NO: 3964 - protein, 7 aa, Artificial Sequence
  source: /note="Description of Artificial Sequence: Synthetic Linker"
VAKEGET

SEQ ID NO: 3965 - protein, 14 aa, Artificial Sequence
  source: /note="Description of Artificial Sequence: Synthetic Linker"
TMKNTGRNVNDRPV

SEQ ID NO: 3966 - protein, 4 aa, Artificial Sequence
  source: /note="Description of Artificial Sequence: Synthetic Linker"
EVND

SEQ ID NO: 3967 - protein, 4 aa, Artificial Sequence
  source: /note="Description of Artificial Sequence: Synthetic Linker"
NSDG

SEQ ID NO: 3968 - protein, 4 aa, Artificial Sequence
  source: /note="Description of Artificial Sequence: Synthetic Linker"
TPYG

SEQ ID NO: 3969 - protein, 5 aa, Artificial Sequence
  source: /note="Description of Artificial Sequence: Synthetic Linker"
GRGNP

SEQ ID NO: 3970 - protein, 5 aa, Artificial Sequence
  source: /note="Description of Artificial Sequence: Synthetic Linker"
SENPV

SEQ ID NO: 3971 - protein, 6 aa, Artificial Sequence
  source: /note="Description of Artificial Sequence: Synthetic Linker"
RAQMDL

SEQ ID NO: 3972 - protein, 6 aa, Artificial Sequence
  source: /note="Description of Artificial Sequence: Synthetic Linker"
RTSRNP

SEQ ID NO: 3973 - protein, 6 aa, Artificial Sequence
  source: /note="Description of Artificial Sequence: Synthetic Linker"
YVLNDI

SEQ ID NO: 3974 - protein, 7 aa, Artificial Sequence
  source: /note="Description of Artificial Sequence: Synthetic Linker"
AKKDGTH

SEQ ID NO: 3975 - protein, 8 aa, Artificial Sequence
  source: /note="Description of Artificial Sequence: Synthetic Linker"
DATHIGKL

SEQ ID NO: 3976 - protein, 8 aa, Artificial Sequence
  source: /note="Description of Artificial Sequence: Synthetic Linker"
KQIGGDGM

SEQ ID NO: 3977 - protein, 8 aa, Artificial Sequence
  source: /note="Description of Artificial Sequence: Synthetic Linker"
VLTIPEII

SEQ ID NO: 3978 - protein, 8 aa, Artificial Sequence
  source: /note="Description of Artificial Sequence: Synthetic Linker"
YKFQEGQE

SEQ ID NO: 3979 - protein, 9 aa, Artificial Sequence
  source: /note="Description of Artificial Sequence: Synthetic Linker"
NAKDDEGVL

SEQ ID NO: 3980 - protein, 9 aa, Artificial Sequence
  source: /note="Description of Artificial Sequence: Synthetic Linker"
SYGQFEDGI

SEQ ID NO: 3981 - protein, 10 aa, Artificial Sequence
  source: /note="Description of Artificial Sequence: Synthetic Linker"
HGHVCFQFDA

SEQ ID NO: 3982 - protein, 16 aa, Artificial Sequence
  source: /note="Description of Artificial Sequence: Synthetic Linker"
LFNPWCEDDAVYLDNE

SEQ ID NO: 3983 - protein, 20 aa, Artificial Sequence
  source: /note="Description of Artificial Sequence: Synthetic Linker"
GSWDNIYAYGVPPSAWTGSV

SEQ ID NO: 3984 - protein, 20 aa, Artificial Sequence
  source: /note="Description of Artificial Sequence: Synthetic Linker"
MYGAKKPLNTEGVMKSRSNV

SEQ ID NO: 3985 - protein, 5 aa, Artificial Sequence
  source: /note="Description of Artificial Sequence: Synthetic Linker"
CPPCP

SEQ ID NO: 3986 - protein, 6 aa, Artificial Sequence
  source: /note="Description of Artificial Sequence: Synthetic Linker"
QPKAAP

SEQ ID NO: 3987 - protein, 25 aa, Artificial Sequence
  source: /note="Description of Artificial Sequence: Synthetic Linker"
PPPPPASSTTFSTTRRSSTTSSSPS

SEQ ID NO: 3988 - protein, 27 aa, Artificial Sequence
  source: /note="Description of Artificial Sequence: Synthetic Linker"
GGNPPGGNPPGTTTPRPATSTGSSPGP

SEQ ID NO: 3989 - protein, 33 aa, Artificial Sequence
  source: /note="Description of Artificial Sequence: Synthetic Linker"
GTSTGGSTTTTASGTTSTKASTTSTSSTSTGTG

SEQ ID NO: 3990 - protein, 33 aa, Artificial Sequence
  source: /note="Description of Artificial Sequence: Synthetic Linker"
TVSSSSVSSSHSSTSTSSSHSSSSTPPTQPTGV

SEQ ID NO: 3991 - protein, 34 aa, Artificial Sequence
  source: /note="Description of Artificial Sequence: Synthetic Linker"
GSSGTPPSNPSSSASPTSSTAKPSSTSTASNPSG

SEQ ID NO: 3992 - protein, 41 aa, Artificial Sequence
  source: /note="Description of Artificial Sequence: Synthetic Linker"
ASSSSSTRAASTTSRVSPTTSRSSSATPPPGSTTTRVPPVG

SEQ ID NO: 3993 - protein, 48 aa, Artificial Sequence
  source: /note="Description of Artificial Sequence: Synthetic Linker"
PSSGGTSSSSSAAPQSTSTKASTTTSAVRTTSTATTKTTSSAPAQGTN

SEQ ID NO: 3994 - protein, 6 aa, Artificial Sequence
  source: /note="Description of Artificial Sequence: Synthetic Linker"
ASTKGP

SEQ ID NO: 3995 - protein, 12 aa, Artificial Sequence
  source: /note="Description of Artificial Sequence: Synthetic Linker"
TVAAPSVFIFPP

SEQ ID NO: 3996 - protein, 13 aa, Artificial Sequence
  source: /note="Description of Artificial Sequence: Synthetic Linker"
ASTKGPSVFPLAP

SEQ ID NO: 3997 - protein, 13 aa, Artificial Sequence
  source: /note="Description of Artificial Sequence: Synthetic Linker"
QPKAAPSVTLFPP

SEQ ID NO: 3998 - protein, 5 aa, Artificial Sequence
  source: /note="Description of Artificial Sequence: Synthetic Linker"
RSANS

SEQ ID NO: 3999 - protein, 9 aa, Artificial Sequence
  source: /note="Description of Artificial Sequence: Synthetic Linker"
RPAKLALPP

SEQ ID NO: 4000 - protein, 17 aa, Artificial Sequence
  source: /note="Description of Artificial Sequence: Synthetic Linker"
SLHGFDLASEQHTVRDT

SEQ ID NO: 4001 - protein, 4 aa, Artificial Sequence
  source: /note="Description of Artificial Sequence: Synthetic Linker"
RARI

SEQ ID NO: 4002 - protein, 11 aa, Artificial Sequence
  source: /note="Description of Artificial Sequence: Synthetic Linker"
TKPQLGIREGM

SEQ ID NO: 4003 - protein, 21 aa, Artificial Sequence
  source: /note="Description of Artificial Sequence: Synthetic Linker"
HKPMAAPTTLKAGPLLSSEKL

SEQ ID NO: 4004 - protein, 12 aa, Artificial Sequence
  source: /note="Description of Artificial Sequence: Synthetic Linker"
SLPADRKPGEPV

SEQ ID NO: 4005 - protein, 6 aa, Artificial Sequence
  source: /note="Description of Artificial Sequence: Synthetic Linker"
RRHGEY

SEQ ID NO: 4006 - protein, 7 aa, Artificial Sequence
  source: /note="Description of Artificial Sequence: Synthetic Linker"
ANQNSAE

SEQ ID NO: 4007 - protein, 14 aa, Artificial Sequence
  source: /note="Description of Artificial Sequence: Synthetic Linker"
LTTNLTAFFREAHH

SEQ ID NO: 4008 - protein, 4 aa, Artificial Sequence
  source: /note="Description of Artificial Sequence: Synthetic Linker"
PNQR

SEQ ID NO: 4009 - protein, 5 aa, Artificial Sequence
  source: /note="Description of Artificial Sequence: Synthetic Linker"
ARNDP

SEQ ID NO: 4010 - protein, 5 aa, Artificial Sequence
  source: /note="Description of Artificial Sequence: Synthetic Linker"
LNWTR

SEQ ID NO: 4011 - protein, 6 aa, Artificial Sequence
  source: /note="Description of Artificial Sequence: Synthetic Linker"
DAATDR

SEQ ID NO: 4012 - protein, 6 aa, Artificial Sequence
  source: /note="Description of Artificial Sequence: Synthetic Linker"
DKASGA

SEQ ID NO: 4013 - protein, 6 aa, Artificial Sequence
  source: /note="Description of Artificial Sequence: Synthetic Linker"
GPNGNI

SEQ ID NO: 4014 - protein, 9 aa, Artificial Sequence
  source: /note="Description of Artificial Sequence: Synthetic Linker"
AWDNSDSSV

SEQ ID NO: 4015 - protein, 9 aa, Artificial Sequence
  source: /note="Description of Artificial Sequence: Synthetic Linker"
LAHVGRSLI

SEQ ID NO: 4016 - protein, 9 aa, Artificial Sequence
  source: /note="Description of Artificial Sequence: Synthetic Linker"
TKNPQRGTF

SEQ ID NO: 4017 - protein, 11 aa, Artificial Sequence
  source: /note="Description of Artificial Sequence: Synthetic Linker"
APMPAGLETWV

SEQ ID NO: 4018 - protein, 16 aa, Artificial Sequence
  source: /note="Description of Artificial Sequence: Synthetic Linker"
DTGTLPNLNSEVGAGW

SEQ ID NO: 4019 - protein, 18 aa, Artificial Sequence
  source: /note="Description of Artificial Sequence: Synthetic Linker"
ANHMWNPTGAHQSSIPAL

SEQ ID NO: 4020 - protein, 4 aa, Artificial Sequence
  source: /note="Description of Artificial Sequence: Synthetic Linker"
DATE

SEQ ID NO: 4021 - protein, 7 aa, Artificial Sequence
  source: /note="Description of Artificial Sequence: Synthetic Linker"
RNYLINS

SEQ ID NO: 4022 - protein, 14 aa, Artificial Sequence
  source: /note="Description of Artificial Sequence: Synthetic Linker"
SSPKNLDDKVKLSE

SEQ ID NO: 4023 - protein, 5 aa, Artificial Sequence
  source: /note="Description of Artificial Sequence: Synthetic Linker"
QYQIV

SEQ ID NO: 4024 - protein, 8 aa, Artificial Sequence
  source: /note="Description of Artificial Sequence: Synthetic Linker"
RWLKNASP

SEQ ID NO: 4025 - protein, 14 aa, Artificial Sequence
  source: /note="Description of Artificial Sequence: Synthetic Linker"
NILNDRNPVVTEDV

SEQ ID NO: 4026 - protein, 5 aa, Artificial Sequence
  source: /note="Description of Artificial Sequence: Synthetic Linker"
YTPGE

SEQ ID NO: 4027 - protein, 4 aa, Artificial Sequence
  source: /note="Description of Artificial Sequence: Synthetic Linker"
FGTQ

SEQ ID NO: 4028 - protein, 6 aa, Artificial Sequence
  source: /note="Description of Artificial Sequence: Synthetic Linker"
SLQSGY

SEQ ID NO: 4029 - protein, 6 aa, Artificial Sequence
  source: /note="Description of Artificial Sequence: Synthetic Linker"
TIPANR

SEQ ID NO: 4030 - protein, 9 aa, Artificial Sequence
  source: /note="Description of Artificial Sequence: Synthetic Linker"
KSEKGRNKF

SEQ ID NO: 4031 - protein, 7 aa, Artificial Sequence
  source: /note="Description of Artificial Sequence: Synthetic Linker"
YFNKYSS

SEQ ID NO: 4032 - protein, 8 aa, Artificial Sequence
  source: /note="Description of Artificial Sequence: Synthetic Linker"
YRNPSRNI

SEQ ID NO: 4033 - protein, 4 aa, Artificial Sequence
  source: /note="Description of Artificial Sequence: Synthetic Linker"
YGLN

SEQ ID NO: 4034 - protein, 5 aa, Artificial Sequence
  source: /note="Description of Artificial Sequence: Synthetic Linker"
IMGSV

SEQ ID NO: 4035 - protein, 5 aa, Artificial Sequence
  source: /note="Description of Artificial Sequence: Synthetic Linker"
SGRDA

SEQ ID NO: 4036 - protein, 6 aa, Artificial Sequence
  source: /note="Description of Artificial Sequence: Synthetic Linker"
LIEKGG

SEQ ID NO: 4037 - protein, 7 aa, Artificial Sequence
  source: /note="Description of Artificial Sequence: Synthetic Linker"
DINNISP

SEQ ID NO: 4038 - protein, 7 aa, Artificial Sequence
  source: /note="Description of Artificial Sequence: Synthetic Linker"
GRHVRGI

SEQ ID NO: 4039 - protein, 8 aa, Artificial Sequence
  source: /note="Description of Artificial Sequence: Synthetic Linker"
VRGREPGD

SEQ ID NO: 4040 - protein, 6 aa, Artificial Sequence
  source: /note="Description of Artificial Sequence: Synthetic Linker"
EMEIPE

SEQ ID NO: 4041 - protein, 6 aa, Artificial Sequence
  source: /note="Description of Artificial Sequence: Synthetic Linker"
RMIKSA

SEQ ID NO: 4042 - protein, 4 aa, Artificial Sequence
  source: /note="Description of Artificial Sequence: Synthetic Linker"
GFTP

SEQ ID NO: 4043 - protein, 5 aa, Artificial Sequence
  source: /note="Description of Artificial Sequence: Synthetic Linker"
FKIDV

SEQ ID NO: 4044 - protein, 5 aa, Artificial Sequence
  source: /note="Description of Artificial Sequence: Synthetic Linker"
NLDDP

SEQ ID NO: 4045 - protein, 11 aa, Artificial Sequence
  source: /note="Description of Artificial Sequence: Synthetic Linker"
LQNQQDNRGNI

SEQ ID NO: 4046 - protein, 19 aa, Artificial Sequence
  source: /note="Description of Artificial Sequence: Synthetic Linker"
NPQGQVWIEGREQQPQKNI

SEQ ID NO: 4047 - protein, 35 aa, Artificial Sequence
  source: /note="Description of Artificial Sequence: Synthetic Linker"
RVQGPFSVIRPPLRSQRPQEEVNGLEETICSARCT

SEQ ID NO: 4048 - protein, 53 aa, Artificial Sequence
  source: /note="Description of Artificial Sequence: Synthetic Linker"
DSSVFQPGGGSPFGEGQGQGQQGQGQGHQGQGQGQQGQQGQQGQQSQGQGFRD

SEQ ID NO: 4049 - protein, 5 aa, Artificial Sequence
  source: /note="Description of Artificial Sequence: Synthetic Linker"
CEGSD

SEQ ID NO: 4050 - protein, 7 aa, Artificial Sequence
  source: /note="Description of Artificial Sequence: Synthetic Linker"
VQQQETI

SEQ ID NO: 4051 - protein, 8 aa, Artificial Sequence
  source: /note="Description of Artificial Sequence: Synthetic Linker"
KGINSKKT

SEQ ID NO: 4052 - protein, 12 aa, Artificial Sequence
  source: /note="Description of Artificial Sequence: Synthetic Linker"
RLKLEDRQVDLT

SEQ ID NO: 4053 - protein, 8 aa, Artificial Sequence
  source: /note="Description of Artificial Sequence: Synthetic Linker"
TDSTQIKM

SEQ ID NO: 4054 - protein, 11 aa, Artificial Sequence
  source: /note="Description of Artificial Sequence: Synthetic Linker"
ILLQYNTEDAY

SEQ ID NO: 4055 - protein, 14 aa, Artificial Sequence
  source: /note="Description of Artificial Sequence: Synthetic Linker"
ELVTNCFKNRYTLQ

SEQ ID NO: 4056 - protein, 23 aa, Artificial Sequence
  source: /note="Description of Artificial Sequence: Synthetic Linker"
IKLYLGYKNKKLRVNINVPMKTE

SEQ ID NO: 4057 - protein, 24 aa, Artificial Sequence
  source: /note="Description of Artificial Sequence: Synthetic Linker"
KSKLLVLEDENANVDEVELKPDTL

SEQ ID NO: 4058 - protein, 11 aa, Artificial Sequence
  source: /note="Description of Artificial Sequence: Synthetic Linker"
VLTFDLAAPTV

SEQ ID NO: 4059 - protein, 27 aa, Artificial Sequence
  source: /note="Description of Artificial Sequence: Synthetic Linker"
CPAGNFIGKTATPYTSGTPCGDCPSDC

SEQ ID NO: 4060 - protein, 8 aa, Artificial Sequence
  source: /note="Description of Artificial Sequence: Synthetic Linker"
HLPGREAH

SEQ ID NO: 4061 - protein, 8 aa, Artificial Sequence
  source: /note="Description of Artificial Sequence: Synthetic Linker"
YLPDAFGP

SEQ ID NO: 4062 - protein, 21 aa, Artificial Sequence
  source: /note="Description of Artificial Sequence: Synthetic Linker"
LEIKTLLMDEQDHGYALTGDA

SEQ ID NO: 4063 - protein, 7 aa, Artificial Sequence
  source: /note="Description of Artificial Sequence: Synthetic Linker"
VLAMAKV

SEQ ID NO: 4064 - protein, 4 aa, Artificial Sequence
  source: /note="Description of Artificial Sequence: Synthetic Linker"
FAFG

SEQ ID NO: 4065 - protein, 4 aa, Artificial Sequence
  source: /note="Description of Artificial Sequence: Synthetic Linker"
GPNQ

SEQ ID NO: 4066 - protein, 8 aa, Artificial Sequence
  source: /note="Description of Artificial Sequence: Synthetic Linker"
DEINNPSL

SEQ ID NO: 4067 - protein, 24 aa, Artificial Sequence
  source: /note="Description of Artificial Sequence: Synthetic Linker"
VIPAGKLERVDPTTVRQEGPWADP

SEQ ID NO: 4068 - protein, 15 aa, Artificial Sequence
  source: /note="Description of Artificial Sequence: Synthetic Linker"
LGVSSSEVSRVEADS

SEQ ID NO: 4069 - protein, 6 aa, Artificial Sequence
  source: /note="Description of Artificial Sequence: Synthetic Linker"
AIPDFG

SEQ ID NO: 4070 - protein, 6 aa, Artificial Sequence
  source: /note="Description of Artificial Sequence: Synthetic Linker"
VDPAYR

SEQ ID NO: 4071 - protein, 6 aa, Artificial Sequence
  source: /note="Description of Artificial Sequence: Synthetic Linker"
YAPSSP

SEQ ID NO: 4072 - protein, 23 aa, Artificial Sequence
  source: /note="Description of Artificial Sequence: Synthetic Linker"
ATPQMEEDKGPINHPQYPGDVGL

SEQ ID NO: 4073 - protein, 4 aa, Artificial Sequence
  source: /note="Description of Artificial Sequence: Synthetic Linker"
IWEP

SEQ ID NO: 4074 - protein, 6 aa, Artificial Sequence
  source: /note="Description of Artificial Sequence: Synthetic Linker"
RTDIQT

SEQ ID NO: 4075 - protein, 13 aa, Artificial Sequence
  source: /note="Description of Artificial Sequence: Synthetic Linker"
KIPFTANKFEKNY

SEQ ID NO: 4076 - protein, 10 aa, Artificial Sequence
  source: /note="Description of Artificial Sequence: Synthetic Linker"
LEGDKNALNQ

SEQ ID NO: 4077 - protein, 4 aa, Artificial Sequence
  source: /note="Description of Artificial Sequence: Synthetic Linker"
AGGD

SEQ ID NO: 4078 - protein, 4 aa, Artificial Sequence
  source: /note="Description of Artificial Sequence: Synthetic Linker"
KADV

SEQ ID NO: 4079 - protein, 4 aa, Artificial Sequence
  source: /note="Description of Artificial Sequence: Synthetic Linker"
KGGR

SEQ ID NO: 4080 - protein, 4 aa, Artificial Sequence
  source: /note="Description of Artificial Sequence: Synthetic Linker"
LGTF

SEQ ID NO: 4081 - protein, 4 aa, Artificial Sequence
  source: /note="Description of Artificial Sequence: Synthetic Linker"
LPFL

SEQ ID NO: 4082 - protein, 4 aa, Artificial Sequence
  source: /note="Description of Artificial Sequence: Synthetic Linker"
QKGK

SEQ ID NO: 4083 - protein, 5 aa, Artificial Sequence
  source: /note="Description of Artificial Sequence: Synthetic Linker"
EEKCE

SEQ ID NO: 4084 - protein, 5 aa, Artificial Sequence
  source: /note="Description of Artificial Sequence: Synthetic Linker"
LGAGD

SEQ ID NO: 4085 - protein, 5 aa, Artificial Sequence
  source: /note="Description of Artificial Sequence: Synthetic Linker"
LKSIE

SEQ ID NO: 4086 - protein, 5 aa, Artificial Sequence
  source: /note="Description of Artificial Sequence: Synthetic Linker"
PKTDD

SEQ ID NO: 4087 - protein, 5 aa, Artificial Sequence
  source: /note="Description of Artificial Sequence: Synthetic Linker"
SAFGS

SEQ ID NO: 4088 - protein, 5 aa, Artificial Sequence
  source: /note="Description of Artificial Sequence: Synthetic Linker"
VLRDP

SEQ ID NO: 4089 - protein, 6 aa, Artificial Sequence
  source: /note="Description of Artificial Sequence: Synthetic Linker"
EEGYKA

SEQ ID NO: 4090 - protein, 6 aa, Artificial Sequence
  source: /note="Description of Artificial Sequence: Synthetic Linker"
KDLGVK

SEQ ID NO: 4091 - protein, 6 aa, Artificial Sequence
  source: /note="Description of Artificial Sequence: Synthetic Linker"
LVDISV

SEQ ID NO: 4092 - protein, 6 aa, Artificial Sequence
  source: /note="Description of Artificial Sequence: Synthetic Linker"
NIRAVP

SEQ ID NO: 4093 - protein, 6 aa, Artificial Sequence
  source: /note="Description of Artificial Sequence: Synthetic Linker"
RCGARR

SEQ ID NO: 4094 - protein, 6 aa, Artificial Sequence
  source: /note="Description of Artificial Sequence: Synthetic Linker"
VFRKGF

SEQ ID NO: 4095 - protein, 6 aa, Artificial Sequence
  source: /note="Description of Artificial Sequence: Synthetic Linker"
VIGKAL

SEQ ID NO: 4096 - protein, 7 aa, Artificial Sequence
  source: /note="Description of Artificial Sequence: Synthetic Linker"
IGIGLPE

SEQ ID NO: 4097 - protein, 7 aa, Artificial Sequence
  source: /note="Description of Artificial Sequence: Synthetic Linker"
QDETGKW

SEQ ID NO: 4098 - protein, 7 aa, Artificial Sequence
  source: /note="Description of Artificial Sequence: Synthetic Linker"
VGMANTT

SEQ ID NO: 4099 - protein, 8 aa, Artificial Sequence
  source: /note="Description of Artificial Sequence: Synthetic Linker"
ELSNIEQV

SEQ ID NO: 4100 - protein, 10 aa, Artificial Sequence
  source: /note="Description of Artificial Sequence: Synthetic Linker"
FQGLTQDQGF

SEQ ID NO: 4101 - protein, 12 aa, Artificial Sequence
  source: /note="Description of Artificial Sequence: Synthetic Linker"
CGKSLSENEITL

SEQ ID NO: 4102 - protein, 14 aa, Artificial Sequence
  source: /note="Description of Artificial Sequence: Synthetic Linker"
LQGWDGQSPGTESH

SEQ ID NO: 4103 - protein, 17 aa, Artificial Sequence
  source: /note="Description of Artificial Sequence: Synthetic Linker"
PVPRIAELMGKKLPNFG

SEQ ID NO: 4104 - protein, 18 aa, Artificial Sequence
  source: /note="Description of Artificial Sequence: Synthetic Linker"
QYGASVSAKPELPLFYTP

SEQ ID NO: 4105 - protein, 18 aa, Artificial Sequence
  source: /note="Description of Artificial Sequence: Synthetic Linker"
SKAGMCACHSPLPSIRGA

SEQ ID NO: 4106 - protein, 23 aa, Artificial Sequence
  source: /note="Description of Artificial Sequence: Synthetic Linker"
EQNAAFPPLERKPFIPKKPIPAI

SEQ ID NO: 4107 - protein, 28 aa, Artificial Sequence
  source: /note="Description of Artificial Sequence: Synthetic Linker"
EALSPIKFNRWDLPEVDPETMQTSEPWV

SEQ ID NO: 4108 - protein, 7 aa, Artificial Sequence
  source: /note="Description of Artificial Sequence: Synthetic Linker"
NTGSGKR

SEQ ID NO: 4109 - protein, 7 aa, Artificial Sequence
  source: /note="Description of Artificial Sequence: Synthetic Linker"
TQPVQSS

SEQ ID NO: 4110 - protein, 7 aa, Artificial Sequence
  source: /note="Description of Artificial Sequence: Synthetic Linker"
YTGDNCA

SEQ ID NO: 4111 - protein, 18 aa, Artificial Sequence
  source: /note="Description of Artificial Sequence: Synthetic Linker"
LPRDGLKDPQGKPLHYDR

SEQ ID NO: 4112 - protein, 7 aa, Artificial Sequence
  source: /note="Description of Artificial Sequence: Synthetic Linker"
DDDRIKD

SEQ ID NO: 4113 - protein, 7 aa, Artificial Sequence
  source: /note="Description of Artificial Sequence: Synthetic Linker"
EAEKNQQ

SEQ ID NO: 4114 - protein, 11 aa, Artificial Sequence
  source: /note="Description of Artificial Sequence: Synthetic Linker"
NHLGIDLGETP

SEQ ID NO: 4115 - protein, 13 aa, Artificial Sequence
  source: /note="Description of Artificial Sequence: Synthetic Linker"
RLFESSGCAGKLA

SEQ ID NO: 4116 - protein, 13 aa, Artificial Sequence
  source: /note="Description of Artificial Sequence: Synthetic Linker"
VRHDGRHAHDYDY

SEQ ID NO: 4117 - protein, 15 aa, Artificial Sequence
  source: /note="Description of Artificial Sequence: Synthetic Linker"
RDIEADTPARYNADP

SEQ ID NO: 4118 - protein, 4 aa, Artificial Sequence
  source: /note="Description of Artificial Sequence: Synthetic Linker"
LSSR

SEQ ID NO: 4119 - protein, 4 aa, Artificial Sequence
  source: /note="Description of Artificial Sequence: Synthetic Linker"
SILM

SEQ ID NO: 4120 - protein, 5 aa, Artificial Sequence
  source: /note="Description of Artificial Sequence: Synthetic Linker"
DTSGG

SEQ ID NO: 4121 - protein, 5 aa, Artificial Sequence
  source: /note="Description of Artificial Sequence: Synthetic Linker"
LGDGA

SEQ ID NO: 4122 - protein, 6 aa, Artificial Sequence
  source: /note="Description of Artificial Sequence: Synthetic Linker"
ANNSTL

SEQ ID NO: 4123 - protein, 6 aa, Artificial Sequence
  source: /note="Description of Artificial Sequence: Synthetic Linker"
IDEIQK

SEQ ID NO: 4124 - protein, 6 aa, Artificial Sequence
  source: /note="Description of Artificial Sequence: Synthetic Linker"
KLPSFE

SEQ ID NO: 4125 - protein, 6 aa, Artificial Sequence
  source: /note="Description of Artificial Sequence: Synthetic Linker"
QEVSQC

SEQ ID NO: 4126 - protein, 6 aa, Artificial Sequence
  source: /note="Description of Artificial Sequence: Synthetic Linker"
RSLSTT

SEQ ID NO: 4127 - protein, 6 aa, Artificial Sequence
  source: /note="Description of Artificial Sequence: Synthetic Linker"
SSNHKL

SEQ ID NO: 4128 - protein, 6 aa, Artificial Sequence
  source: /note="Description of Artificial Sequence: Synthetic Linker"
TFESSH

SEQ ID NO: 4129 - protein, 7 aa, Artificial Sequence
  source: /note="Description of Artificial Sequence: Synthetic Linker"
TALRPSA

SEQ ID NO: 4130 - protein, 8 aa, Artificial Sequence
  source: /note="Description of Artificial Sequence: Synthetic Linker"
PLYESPRK

SEQ ID NO: 4131 - protein, 9 aa, Artificial Sequence
  source: /note="Description of Artificial Sequence: Synthetic Linker"
LNSDGYPDS

SEQ ID NO: 4132 - protein, 9 aa, Artificial Sequence
  source: /note="Description of Artificial Sequence: Synthetic Linker"
LWTDISARI

SEQ ID NO: 4133 - protein, 11 aa, Artificial Sequence
  source: /note="Description of Artificial Sequence: Synthetic Linker"
HKEMLGGEIIP

SEQ ID NO: 4134 - protein, 12 aa, Artificial Sequence
  source: /note="Description of Artificial Sequence: Synthetic Linker"
TLGTQPTVLRTF

SEQ ID NO: 4135 - protein, 12 aa, Artificial Sequence
  source: /note="Description of Artificial Sequence: Synthetic Linker"
VFSNVNLKEVNY

SEQ ID NO: 4136 - protein, 13 aa, Artificial Sequence
  source: /note="Description of Artificial Sequence: Synthetic Linker"
NVFACSDRPTVIY

SEQ ID NO: 4137 - protein, 14 aa, Artificial Sequence
  source: /note="Description of Artificial Sequence: Synthetic Linker"
DITPLGDSNGLSPL

SEQ ID NO: 4138 - protein, 14 aa, Artificial Sequence
  source: /note="Description of Artificial Sequence: Synthetic Linker"
FGLNIETGLLSDRK

SEQ ID NO: 4139 - protein, 29 aa, Artificial Sequence
  source: /note="Description of Artificial Sequence: Synthetic Linker"
TQALSSSVSSSKLFSSSTAPHETSFGEEV

SEQ ID NO: 4140 - protein, 4 aa, Artificial Sequence
  source: /note="Description of Artificial Sequence: Synthetic Linker"
EHGV

SEQ ID NO: 4141 - protein, 4 aa, Artificial Sequence
  source: /note="Description of Artificial Sequence: Synthetic Linker"
REGK

SEQ ID NO: 4142 - protein, 5 aa, Artificial Sequence
  source: /note="Description of Artificial Sequence: Synthetic Linker"
TVLHA

SEQ ID NO: 4143 - protein, 6 aa, Artificial Sequence
  source: /note="Description of Artificial Sequence: Synthetic Linker"
ETEKTG

SEQ ID NO: 4144 - protein, 6 aa, Artificial Sequence
  source: /note="Description of Artificial Sequence: Synthetic Linker"
FHYEGG

SEQ ID NO: 4145 - protein, 6 aa, Artificial Sequence
  source: /note="Description of Artificial Sequence: Synthetic Linker"
LDSGVS

SEQ ID NO: 4146 - protein, 6 aa, Artificial Sequence
  source: /note="Description of Artificial Sequence: Synthetic Linker"
PQAPLA

SEQ ID NO: 4147 - protein, 7 aa, Artificial Sequence
  source: /note="Description of Artificial Sequence: Synthetic Linker"
DKRDGKE

SEQ ID NO: 4148 - protein, 8 aa, Artificial Sequence
  source: /note="Description of Artificial Sequence: Synthetic Linker"
IHPEEGVS

SEQ ID NO: 4149 - protein, 14 aa, Artificial Sequence
  source: /note="Description of Artificial Sequence: Synthetic Linker"
PSLETFTNVTEFEY

SEQ ID NO: 4150 - protein, 19 aa, Artificial Sequence
  source: /note="Description of Artificial Sequence: Synthetic Linker"
GGKFDDNSYKVSGGLHGVG

SEQ ID NO: 4151 - protein, 5 aa, Artificial Sequence
  source: /note="Description of Artificial Sequence: Synthetic Linker"
MKPEN

SEQ ID NO: 4152 - protein, 6 aa, Artificial Sequence
  source: /note="Description of Artificial Sequence: Synthetic Linker"
TNISRA

SEQ ID NO: 4153 - protein, 7 aa, Artificial Sequence
  source: /note="Description of Artificial Sequence: Synthetic Linker"
LLESGRL

SEQ ID NO: 4154 - protein, 15 aa, Artificial Sequence
  source: /note="Description of Artificial Sequence: Synthetic Linker"
VWGTKGLANEGKVIG

SEQ ID NO: 4155 - protein, 28 aa, Artificial Sequence
  source: /note="Description of Artificial Sequence: Synthetic Linker"
TLSQWGFFSPYGIGDNDACTINPYDGWA

SEQ ID NO: 4156 - protein, 4 aa, Artificial Sequence
  source: /note="Description of Artificial Sequence: Synthetic Linker"
MERE

SEQ ID NO: 4157 - protein, 7 aa, Artificial Sequence
  source: /note="Description of Artificial Sequence: Synthetic Linker"
FIDKPGI

SEQ ID NO: 4158 - protein, 8 aa, Artificial Sequence
  source: /note="Description of Artificial Sequence: Synthetic Linker"
TLNYTCPT

SEQ ID NO: 4159 - protein, 10 aa, Artificial Sequence
  source: /note="Description of Artificial Sequence: Synthetic Linker"
LLQERQDNLL

SEQ ID NO: 4160 - protein, 12 aa, Artificial Sequence
  source: /note="Description of Artificial Sequence: Synthetic Linker"
QRTTLPHIRSIT

SEQ ID NO: 4161 - protein, 4 aa, Artificial Sequence
  source: /note="Description of Artificial Sequence: Synthetic Linker"
VGGF

SEQ ID NO: 4162 - protein, 5 aa, Artificial Sequence
  source: /note="Description of Artificial Sequence: Synthetic Linker"
AKIQI

SEQ ID NO: 4163 - protein, 5 aa, Artificial Sequence
  source: /note="Description of Artificial Sequence: Synthetic Linker"
KEQNK

SEQ ID NO: 4164 - protein, 7 aa, Artificial Sequence
  source: /note="Description of Artificial Sequence: Synthetic Linker"
PGPKCPF

SEQ ID NO: 4165 - protein, 9 aa, Artificial Sequence
  source: /note="Description of Artificial Sequence: Synthetic Linker"
QLNYISIAS

SEQ ID NO: 4166 - protein, 9 aa, Artificial Sequence
  source: /note="Description of Artificial Sequence: Synthetic Linker"
SANNIAKYD

SEQ ID NO: 4167 - protein, 16 aa, Artificial Sequence
  source: /note="Description of Artificial Sequence: Synthetic Linker"
AIKGNIDAPQVVEGEK

SEQ ID NO: 4168 - protein, 18 aa, Artificial Sequence
  source: /note="Description of Artificial Sequence: Synthetic Linker"
VIPQGRSHPVQPYPGAFV

SEQ ID NO: 4169 - protein, 4 aa, Artificial Sequence
  source: /note="Description of Artificial Sequence: Synthetic Linker"
ETSR

SEQ ID NO: 4170 - protein, 5 aa, Artificial Sequence
  source: /note="Description of Artificial Sequence: Synthetic Linker"
GVGRR

SEQ ID NO: 4171 - protein, 6 aa, Artificial Sequence
  source: /note="Description of Artificial Sequence: Synthetic Linker"
FFLGQI

SEQ ID NO: 4172 - protein, 6 aa, Artificial Sequence
  source: /note="Description of Artificial Sequence: Synthetic Linker"
LEGSSL

SEQ ID NO: 4173 - protein, 8 aa, Artificial Sequence
  source: /note="Description of Artificial Sequence: Synthetic Linker"
DLSQVNEL

SEQ ID NO: 4174 - protein, 8 aa, Artificial Sequence
  source: /note="Description of Artificial Sequence: Synthetic Linker"
KNANGDYF

SEQ ID NO: 4175 - protein, 11 aa, Artificial Sequence
  source: /note="Description of Artificial Sequence: Synthetic Linker"
ILPLPYPNSPV

SEQ ID NO: 4176 - protein, 12 aa, Artificial Sequence
  source: /note="Description of Artificial Sequence: Synthetic Linker"
FADPTIQSQSEI

SEQ ID NO: 4177 - protein, 13 aa, Artificial Sequence
  source: /note="Description of Artificial Sequence: Synthetic Linker"
CGPYFANDNFSLE

SEQ ID NO: 4178 - protein, 15 aa, Artificial Sequence
  source: /note="Description of Artificial Sequence: Synthetic Linker"
PDSPTYDKFLNPESL

SEQ ID NO: 4179 - protein, 4 aa, Artificial Sequence
  source: /note="Description of Artificial Sequence: Synthetic Linker"
TGDL

SEQ ID NO: 4180 - protein, 6 aa, Artificial Sequence
  source: /note="Description of Artificial Sequence: Synthetic Linker"
FDNEYE

SEQ ID NO: 4181 - protein, 7 aa, Artificial Sequence
  source: /note="Description of Artificial Sequence: Synthetic Linker"
SLKFEGD

SEQ ID NO: 4182 - protein, 13 aa, Artificial Sequence
  source: /note="Description of Artificial Sequence: Synthetic Linker"
VFNPEGRDLITDW

SEQ ID NO: 4183 - protein, 15 aa, Artificial Sequence
  source: /note="Description of Artificial Sequence: Synthetic Linker"
GGNYDINSHLPLIPE

SEQ ID NO: 4184 - protein, 5 aa, Artificial Sequence
  source: /note="Description of Artificial Sequence: Synthetic Linker"
RNEQD

SEQ ID NO: 4185 - protein, 4 aa, Artificial Sequence
  source: /note="Description of Artificial Sequence: Synthetic Linker"
KEGK

SEQ ID NO: 4186 - protein, 5 aa, Artificial Sequence
  source: /note="Description of Artificial Sequence: Synthetic Linker"
MEQAM

SEQ ID NO: 4187 - protein, 6 aa, Artificial Sequence
  source: /note="Description of Artificial Sequence: Synthetic Linker"
ILRVNV

SEQ ID NO: 4188 - protein, 7 aa, Artificial Sequence
  source: /note="Description of Artificial Sequence: Synthetic Linker"
LPDGEDP

SEQ ID NO: 4189 - protein, 7 aa, Artificial Sequence
  source: /note="Description of Artificial Sequence: Synthetic Linker"
LSIGIRR

SEQ ID NO: 4190 - protein, 8 aa, Artificial Sequence
  source: /note="Description of Artificial Sequence: Synthetic Linker"
DNAEPNRL

SEQ ID NO: 4191 - protein, 17 aa, Artificial Sequence
  source: /note="Description of Artificial Sequence: Synthetic Linker"
GFVRKAILASFPEGVGI

SEQ ID NO: 4192 - protein, 4 aa, Artificial Sequence
  source: /note="Description of Artificial Sequence: Synthetic Linker"
VDGV

SEQ ID NO: 4193 - protein, 5 aa, Artificial Sequence
  source: /note="Description of Artificial Sequence: Synthetic Linker"
LWNGG

SEQ ID NO: 4194 - protein, 5 aa, Artificial Sequence
  source: /note="Description of Artificial Sequence: Synthetic Linker"
RGISK

SEQ ID NO: 4195 - protein, 7 aa, Artificial Sequence
  source: /note="Description of Artificial Sequence: Synthetic Linker"
CYVCEKW

SEQ ID NO: 4196 - protein, 7 aa, Artificial Sequence
  source: /note="Description of Artificial Sequence: Synthetic Linker"
RDQNGNI

SEQ ID NO: 4197 - protein, 8 aa, Artificial Sequence
  source: /note="Description of Artificial Sequence: Synthetic Linker"
RDKDKNFK

SEQ ID NO: 4198 - protein, 8 aa, Artificial Sequence
  source: /note="Description of Artificial Sequence: Synthetic Linker"
TAGNEDTK

SEQ ID NO: 4199 - protein, 9 aa, Artificial Sequence
  source: /note="Description of Artificial Sequence: Synthetic Linker"
ESNGRYSAL

SEQ ID NO: 4200 - protein, 11 aa, Artificial Sequence
  source: /note="Description of Artificial Sequence: Synthetic Linker"
GSHKSDALFGK

SEQ ID NO: 4201 - protein, 18 aa, Artificial Sequence
  source: /note="Description of Artificial Sequence: Synthetic Linker"
SKRKPSGGKPGTYNVWNF

SEQ ID NO: 4202 - protein, 4 aa, Artificial Sequence
  source: /note="Description of Artificial Sequence: Synthetic Linker"
FYNM

SEQ ID NO: 4203 - protein, 4 aa, Artificial Sequence
  source: /note="Description of Artificial Sequence: Synthetic Linker"
KFTW

SEQ ID NO: 4204 - protein, 6 aa, Artificial Sequence
  source: /note="Description of Artificial Sequence: Synthetic Linker"
FITPII

SEQ ID NO: 4205 - protein, 6 aa, Artificial Sequence
  source: /note="Description of Artificial Sequence: Synthetic Linker"
FSKKKA

SEQ ID NO: 4206 - protein, 7 aa, Artificial Sequence
  source: /note="Description of Artificial Sequence: Synthetic Linker"
SNLDRHL

SEQ ID NO: 4207 - protein, 8 aa, Artificial Sequence
  source: /note="Description of Artificial Sequence: Synthetic Linker"
FHSLQGND

SEQ ID NO: 4208 - protein, 8 aa, Artificial Sequence
  source: /note="Description of Artificial Sequence: Synthetic Linker"
ITKPTKNT

SEQ ID NO: 4209 - protein, 10 aa, Artificial Sequence
  source: /note="Description of Artificial Sequence: Synthetic Linker"
YYKGLGTSLA

SEQ ID NO: 4210 - protein, 14 aa, Artificial Sequence
  source: /note="Description of Artificial Sequence: Synthetic Linker"
QYEPGTVLDPTLKE

SEQ ID NO: 4211 - protein, 6 aa, Artificial Sequence
  source: /note="Description of Artificial Sequence: Synthetic Linker"
LNPSSR

SEQ ID NO: 4212 - protein, 8 aa, Artificial Sequence
  source: /note="Description of Artificial Sequence: Synthetic Linker"
QRAPPKTF

SEQ ID NO: 4213 - protein, 12 aa, Artificial Sequence
  source: /note="Description of Artificial Sequence: Synthetic Linker"
ADAKVMKDAKTK

SEQ ID NO: 4214 - protein, 4 aa, Artificial Sequence
  source: /note="Description of Artificial Sequence: Synthetic Linker"
LNGN

SEQ ID NO: 4215 - protein, 5 aa, Artificial Sequence
  source: /note="Description of Artificial Sequence: Synthetic Linker"
AGEME

SEQ ID NO: 4216 - protein, 6 aa, Artificial Sequence
  source: /note="Description of Artificial Sequence: Synthetic Linker"
MDNMGR

SEQ ID NO: 4217 - protein, 6 aa, Artificial Sequence
  source: /note="Description of Artificial Sequence: Synthetic Linker"
SREYKK

SEQ ID NO: 4218 - protein, 6 aa, Artificial Sequence
  source: /note="Description of Artificial Sequence: Synthetic Linker"
STKDVK

SEQ ID NO: 4219 - protein, 7 aa, Artificial Sequence
  source: /note="Description of Artificial Sequence: Synthetic Linker"
KLPVKGF

SEQ ID NO: 4220 - protein, 7 aa, Artificial Sequence
  source: /note="Description of Artificial Sequence: Synthetic Linker"
PFNGEDY

SEQ ID NO: 4221 - protein, 8 aa, Artificial Sequence
  source: /note="Description of Artificial Sequence: Synthetic Linker"
FKMQSLDK

SEQ ID NO: 4222 - protein, 4 aa, Artificial Sequence
  source: /note="Description of Artificial Sequence: Synthetic Linker"
TPEG

SEQ ID NO: 4223 - protein, 5 aa, Artificial Sequence
  source: /note="Description of Artificial Sequence: Synthetic Linker"
VGPLK

SEQ ID NO: 4224 - protein, 6 aa, Artificial Sequence
  source: /note="Description of Artificial Sequence: Synthetic Linker"
ETDADF

SEQ ID NO: 4225 - protein, 8 aa, Artificial Sequence
  source: /note="Description of Artificial Sequence: Synthetic Linker"
IPEEDGSS

SEQ ID NO: 4226 - protein, 9 aa, Artificial Sequence
  source: /note="Description of Artificial Sequence: Synthetic Linker"
DCTKLGTGA

SEQ ID NO: 4227 - protein, 10 aa, Artificial Sequence
  source: /note="Description of Artificial Sequence: Synthetic Linker"
NIPNDVTKLN

SEQ ID NO: 4228 - protein, 15 aa, Artificial Sequence
  source: /note="Description of Artificial Sequence: Synthetic Linker"
GAARPGLRLPGCVDA

SEQ ID NO: 4229 - protein, 12 aa, Artificial Sequence
  source: /note="Description of Artificial Sequence: Synthetic Linker"
RLRRNDDEPAEM

SEQ ID NO: 4230 - protein, 4 aa, Artificial Sequence
  source: /note="Description of Artificial Sequence: Synthetic Linker"
LDQR

SEQ ID NO: 4231 - protein, 5 aa, Artificial Sequence
  source: /note="Description of Artificial Sequence: Synthetic Linker"
VDGNR

SEQ ID NO: 4232 - protein, 6 aa, Artificial Sequence
  source: /note="Description of Artificial Sequence: Synthetic Linker"
PLRRFY

SEQ ID NO: 4233 - protein, 6 aa, Artificial Sequence
  source: /note="Description of Artificial Sequence: Synthetic Linker"
YAEEDG

SEQ ID NO: 4234 - protein, 6 aa, Artificial Sequence
  source: /note="Description of Artificial Sequence: Synthetic Linker"
YEDGRL

SEQ ID NO: 4235 - protein, 7 aa, Artificial Sequence
  source: /note="Description of Artificial Sequence: Synthetic Linker"
RSNQGTA

SEQ ID NO: 4236 - protein, 10 aa, Artificial Sequence
  source: /note="Description of Artificial Sequence: Synthetic Linker"
DGPASENGFL

SEQ ID NO: 4237 - protein, 14 aa, Artificial Sequence
  source: /note="Description of Artificial Sequence: Synthetic Linker"
PRVVVGQRVRKGDL

SEQ ID NO: 4238 - protein, 16 aa, Artificial Sequence
  source: /note="Description of Artificial Sequence: Synthetic Linker"
ELITNIGETAGVVQDI

SEQ ID NO: 4239 - protein, 20 aa, Artificial Sequence
  source: /note="Description of Artificial Sequence: Synthetic Linker"
SDPTLPRSDRECPKCHSREN

SEQ ID NO: 4240 - protein, 5 aa, Artificial Sequence
  source: /note="Description of Artificial Sequence: Synthetic Linker"
VEGEV

SEQ ID NO: 4241 - protein, 8 aa, Artificial Sequence
  source: /note="Description of Artificial Sequence: Synthetic Linker"
YVPVVQEV

SEQ ID NO: 4242 - protein, 4 aa, Artificial Sequence
  source: /note="Description of Artificial Sequence: Synthetic Linker"
YQNN

SEQ ID NO: 4243 - protein, 5 aa, Artificial Sequence
  source: /note="Description of Artificial Sequence: Synthetic Linker"
LVVNI

SEQ ID NO: 4244 - protein, 6 aa, Artificial Sequence
  source: /note="Description of Artificial Sequence: Synthetic Linker"
EKNFQT

SEQ ID NO: 4245 - protein, 11 aa, Artificial Sequence
  source: /note="Description of Artificial Sequence: Synthetic Linker"
MKLVPSIPPAT

SEQ ID NO: 4246 - protein, 14 aa, Artificial Sequence
  source: /note="Description of Artificial Sequence: Synthetic Linker"
TQPDVPFKNPDNVV

SEQ ID NO: 4247 - protein, 32 aa, Artificial Sequence
  source: /note="Description of Artificial Sequence: Synthetic Linker"
YPEDHNEPQSVRAASSDPGEVVPSACAADEPV

SEQ ID NO: 4248 - protein, 4 aa, Artificial Sequence
  source: /note="Description of Artificial Sequence: Synthetic Linker"
ALCL

SEQ ID NO: 4249 - protein, 4 aa, Artificial Sequence
  source: /note="Description of Artificial Sequence: Synthetic Linker"
LLSL

SEQ ID NO: 4250 - protein, 7 aa, Artificial Sequence
  source: /note="Description of Artificial Sequence: Synthetic Linker"
LNNVRFS

SEQ ID NO: 4251 - protein, 7 aa, Artificial Sequence
  source: /note="Description of Artificial Sequence: Synthetic Linker"
SLCKAHL

SEQ ID NO: 4252 - protein, 8 aa, Artificial Sequence
  source: /note="Description of Artificial Sequence: Synthetic Linker"
EHNNLVNV

SEQ ID NO: 4253 - protein, 8 aa, Artificial Sequence
  source: /note="Description of Artificial Sequence: Synthetic Linker"
YDTGRTGR

SEQ ID NO: 4254 - protein, 11 aa, Artificial Sequence
  source: /note="Description of Artificial Sequence: Synthetic Linker"
QHNLKQNDQPQ

SEQ ID NO: 4255 - protein, 11 aa, Artificial Sequence
  source: /note="Description of Artificial Sequence: Synthetic Linker"
LYPNAQTGHGH

SEQ ID NO: 4256 - protein, 13 aa, Artificial Sequence
  source: /note="Description of Artificial Sequence: Synthetic Linker"
AEVTYKHHEPTGC

SEQ ID NO: 4257 - protein, 4 aa, Artificial Sequence
  source: /note="Description of Artificial Sequence: Synthetic Linker"
MITP

SEQ ID NO: 4258 - protein, 8 aa, Artificial Sequence
  source: /note="Description of Artificial Sequence: Synthetic Linker"
LQHPKIIK

SEQ ID NO: 4259 - protein, 12 aa, Artificial Sequence
  source: /note="Description of Artificial Sequence: Synthetic Linker"
REDEEMGLTTTS

SEQ ID NO: 4260 - protein, 5 aa, Artificial Sequence
  source: /note="Description of Artificial Sequence: Synthetic Linker"
GSREE

SEQ ID NO: 4261 - protein, 4 aa, Artificial Sequence
  source: /note="Description of Artificial Sequence: Synthetic Linker"
ENTC

SEQ ID NO: 4262 - protein, 11 aa, Artificial Sequence
  source: /note="Description of Artificial Sequence: Synthetic Linker"
PVSGAKTFKNE

SEQ ID NO: 4263 - protein, 5 aa, Artificial Sequence
  source: /note="Description of Artificial Sequence: Synthetic Linker"
LSQDD

SEQ ID NO: 4264 - protein, 8 aa, Artificial Sequence
  source: /note="Description of Artificial Sequence: Synthetic Linker"
LLGADDDL

SEQ ID NO: 4265 - protein, 4 aa, Artificial Sequence
  source: /note="Description of Artificial Sequence: Synthetic Linker"
GHGE

SEQ ID NO: 4266 - protein, 4 aa, Artificial Sequence
  source: /note="Description of Artificial Sequence: Synthetic Linker"
PKGR

SEQ ID NO: 4267 - protein, 5 aa, Artificial Sequence
  source: /note="Description of Artificial Sequence: Synthetic Linker"
ALPSP

SEQ ID NO: 4268 - protein, 6 aa, Artificial Sequence
  source: /note="Description of Artificial Sequence: Synthetic Linker"
DYGVEV

SEQ ID NO: 4269 - protein, 6 aa, Artificial Sequence
  source: /note="Description of Artificial Sequence: Synthetic Linker"
EDPSLK

SEQ ID NO: 4270 - protein, 7 aa, Artificial Sequence
  source: /note="Description of Artificial Sequence: Synthetic Linker"
FGDGPPL

SEQ ID NO: 4271 - protein, 8 aa, Artificial Sequence
  source: /note="Description of Artificial Sequence: Synthetic Linker"
RQEETGEL

SEQ ID NO: 4272 - protein, 8 aa, Artificial Sequence
  source: /note="Description of Artificial Sequence: Synthetic Linker"
SVPKVPYR

SEQ ID NO: 4273 - protein, 8 aa, Artificial Sequence
  source: /note="Description of Artificial Sequence: Synthetic Linker"
WQGEKPES

SEQ ID NO: 4274 - protein, 12 aa, Artificial Sequence
  source: /note="Description of Artificial Sequence: Synthetic Linker"
EVPFARLPDPNV

SEQ ID NO: 4275 - protein, 4 aa, Artificial Sequence
  source: /note="Description of Artificial Sequence: Synthetic Linker"
DIYV

SEQ ID NO: 4276 - protein, 6 aa, Artificial Sequence
  source: /note="Description of Artificial Sequence: Synthetic Linker"
IGENIN

SEQ ID NO: 4277 - protein, 7 aa, Artificial Sequence
  source: /note="Description of Artificial Sequence: Synthetic Linker"
AGKITDV

SEQ ID NO: 4278 - protein, 8 aa, Artificial Sequence
  source: /note="Description of Artificial Sequence: Synthetic Linker"
KAGNVAAD

SEQ ID NO: 4279 - protein, 14 aa, Artificial Sequence
  source: /note="Description of Artificial Sequence: Synthetic Linker"
YIPVPTRDLEKPFL

SEQ ID NO: 4280 - protein, 4 aa, Artificial Sequence
  source: /note="Description of Artificial Sequence: Synthetic Linker"
GEHI

SEQ ID NO: 4281 - protein, 4 aa, Artificial Sequence
  source: /note="Description of Artificial Sequence: Synthetic Linker"
EGPE

SEQ ID NO: 4282 - protein, 4 aa, Artificial Sequence
  source: /note="Description of Artificial Sequence: Synthetic Linker"
FEWT

SEQ ID NO: 4283 - protein, 4 aa, Artificial Sequence
  source: /note="Description of Artificial Sequence: Synthetic Linker"
KATY

SEQ ID NO: 4284 - protein, 4 aa, Artificial Sequence
  source: /note="Description of Artificial Sequence: Synthetic Linker"
KDGV

SEQ ID NO: 4285 - protein, 4 aa, Artificial Sequence
  source: /note="Description of Artificial Sequence: Synthetic Linker"
LLGS

SEQ ID NO: 4286 - protein, 4 aa, Artificial Sequence
  source: /note="Description of Artificial Sequence: Synthetic Linker"
VSKS

SEQ ID NO: 4287 - protein, 7 aa, Artificial Sequence
  source: /note="Description of Artificial Sequence: Synthetic Linker"
KAPDGRI

SEQ ID NO: 4288 - protein, 8 aa, Artificial Sequence
  source: /note="Description of Artificial Sequence: Synthetic Linker"
RKASNKAY

SEQ ID NO: 4289 - protein, 10 aa, Artificial Sequence
  source: /note="Description of Artificial Sequence: Synthetic Linker"
YAPILYENDH

SEQ ID NO: 4290 - protein, 4 aa, Artificial Sequence
  source: /note="Description of Artificial Sequence: Synthetic Linker"
YSLG

SEQ ID NO: 4291 - protein, 6 aa, Artificial Sequence
  source: /note="Description of Artificial Sequence: Synthetic Linker"
LDPQWS

SEQ ID NO: 4292 - protein, 7 aa, Artificial Sequence
  source: /note="Description of Artificial Sequence: Synthetic Linker"
REGNGPT

SEQ ID NO: 4293 - protein, 7 aa, Artificial Sequence
  source: /note="Description of Artificial Sequence: Synthetic Linker"
RGEQVAF

SEQ ID NO: 4294 - protein, 8 aa, Artificial Sequence
  source: /note="Description of Artificial Sequence: Synthetic Linker"
QQPHGPYY

SEQ ID NO: 4295 - protein, 11 aa, Artificial Sequence
  source: /note="Description of Artificial Sequence: Synthetic Linker"
LDTWPPETQNW

SEQ ID NO: 4296 - protein, 13 aa, Artificial Sequence
  source: /note="Description of Artificial Sequence: Synthetic Linker"
CFHPASGFAWQFS

SEQ ID NO: 4297 - protein, 16 aa, Artificial Sequence
  source: /note="Description of Artificial Sequence: Synthetic Linker"
GIQSPRPNGPMQTAAN

SEQ ID NO: 4298 - protein, 17 aa, Artificial Sequence
  source: /note="Description of Artificial Sequence: Synthetic Linker"
IDAEEDSTRRMGFETIL

SEQ ID NO: 4299 - protein, 22 aa, Artificial Sequence
  source: /note="Description of Artificial Sequence: Synthetic Linker"
EMPDAPLQPGWDRPETPYSPPL

SEQ ID NO: 4300 - protein, 6 aa, Artificial Sequence
  source: /note="Description of Artificial Sequence: Synthetic Linker"
LLDAPV

SEQ ID NO: 4301 - protein, 5 aa, Artificial Sequence
  source: /note="Description of Artificial Sequence: Synthetic Linker"
EHIDL

SEQ ID NO: 4302 - protein, 5 aa, Artificial Sequence
  source: /note="Description of Artificial Sequence: Synthetic Linker"
FGCDK

SEQ ID NO: 4303 - protein, 7 aa, Artificial Sequence
  source: /note="Description of Artificial Sequence: Synthetic Linker"
CDCKHTT

SEQ ID NO: 4304 - protein, 9 aa, Artificial Sequence
  source: /note="Description of Artificial Sequence: Synthetic Linker"
LNGNDNTIK

SEQ ID NO: 4305 - protein, 10 aa, Artificial Sequence
  source: /note="Description of Artificial Sequence: Synthetic Linker"
ISENKNDAKV

SEQ ID NO: 4306 - protein, 8 aa, Artificial Sequence
  source: /note="Description of Artificial Sequence: Synthetic Linker"
TAACTNTS

SEQ ID NO: 4307 - protein, 4 aa, Artificial Sequence
  source: /note="Description of Artificial Sequence: Synthetic Linker"
LTLL

SEQ ID NO: 4308 - protein, 12 aa, Artificial Sequence
  source: /note="Description of Artificial Sequence: Synthetic Linker"
DWENWQNVGQWR

SEQ ID NO: 4309 - protein, 8 aa, Artificial Sequence
  source: /note="Description of Artificial Sequence: Synthetic Linker"
STKNPVHA

SEQ ID NO: 4310 - protein, 5 aa, Artificial Sequence
  source: /note="Description of Artificial Sequence: Synthetic Linker"
THRNK

SEQ ID NO: 4311 - protein, 12 aa, Artificial Sequence
  source: /note="Description of Artificial Sequence: Synthetic Linker"
IDHVLGVPYTTV

SEQ ID NO: 4312 - protein, 4 aa, Artificial Sequence
  source: /note="Description of Artificial Sequence: Synthetic Linker"
IDGR

SEQ ID NO: 4313 - protein, 4 aa, Artificial Sequence
  source: /note="Description of Artificial Sequence: Synthetic Linker"
KGTQ

SEQ ID NO: 4314 - protein, 5 aa, Artificial Sequence
  source: /note="Description of Artificial Sequence: Synthetic Linker"
ETIKG

SEQ ID NO: 4315 - protein, 6 aa, Artificial Sequence
  source: /note="Description of Artificial Sequence: Synthetic Linker"
ECSSES

SEQ ID NO: 4316 - protein, 7 aa, Artificial Sequence
  source: /note="Description of Artificial Sequence: Synthetic Linker"
LDPTKTI

SEQ ID NO: 4317 - protein, 8 aa, Artificial Sequence
  source: /note="Description of Artificial Sequence: Synthetic Linker"
SKPEAEET

SEQ ID NO: 4318 - protein, 10 aa, Artificial Sequence
  source: /note="Description of Artificial Sequence: Synthetic Linker"
ETAVTQTYGG

SEQ ID NO: 4319 - protein, 11 aa, Artificial Sequence
  source: /note="Description of Artificial Sequence: Synthetic Linker"
FCTDHTVLVQT

SEQ ID NO: 4320 - protein, 4 aa, Artificial Sequence
  source: /note="Description of Artificial Sequence: Synthetic Linker"
SGGT

SEQ ID NO: 4321 - protein, 6 aa, Artificial Sequence
  source: /note="Description of Artificial Sequence: Synthetic Linker"
FNENGI

SEQ ID NO: 4322 - protein, 6 aa, Artificial Sequence
  source: /note="Description of Artificial Sequence: Synthetic Linker"
SFLNSM

SEQ ID NO: 4323 - protein, 7 aa, Artificial Sequence
  source: /note="Description of Artificial Sequence: Synthetic Linker"
QNTGANN

SEQ ID NO: 4324 - protein, 9 aa, Artificial Sequence
  source: /note="Description of Artificial Sequence: Synthetic Linker"
QNGYKPGDL

SEQ ID NO: 4325 - protein, 12 aa, Artificial Sequence
  source: /note="Description of Artificial Sequence: Synthetic Linker"
TTGTINGATAAT

SEQ ID NO: 4326 - protein, 15 aa, Artificial Sequence
  source: /note="Description of Artificial Sequence: Synthetic Linker"
DSSDPAATAPTTAST

SEQ ID NO: 4327 - protein, 11 aa, Artificial Sequence
  source: /note="Description of Artificial Sequence: Synthetic Linker"
AEQPGGWKGWR

SEQ ID NO: 4328 - protein, 7 aa, Artificial Sequence
  source: /note="Description of Artificial Sequence: Synthetic Linker"
VYRFDKE

SEQ ID NO: 4329 - protein, 4 aa, Artificial Sequence
  source: /note="Description of Artificial Sequence: Synthetic Linker"
DAHG

SEQ ID NO: 4330 - protein, 4 aa, Artificial Sequence
  source: /note="Description of Artificial Sequence: Synthetic Linker"
KGAL

SEQ ID NO: 4331 - protein, 5 aa, Artificial Sequence
  source: /note="Description of Artificial Sequence: Synthetic Linker"
RGVEW

SEQ ID NO: 4332 - protein, 6 aa, Artificial Sequence
  source: /note="Description of Artificial Sequence: Synthetic Linker"
VTDHDW

SEQ ID NO: 4333 - protein, 7 aa, Artificial Sequence
  source: /note="Description of Artificial Sequence: Synthetic Linker"
SGLEVSE

SEQ ID NO: 4334 - protein, 8 aa, Artificial Sequence
  source: /note="Description of Artificial Sequence: Synthetic Linker"
LPLPLVPQ

SEQ ID NO: 4335 - protein, 8 aa, Artificial Sequence
  source: /note="Description of Artificial Sequence: Synthetic Linker"
VGEPEMPS

SEQ ID NO: 4336 - protein, 9 aa, Artificial Sequence
  source: /note="Description of Artificial Sequence: Synthetic Linker"
SAILPGRFQ

SEQ ID NO: 4337 - protein, 18 aa, Artificial Sequence
  source: /note="Description of Artificial Sequence: Synthetic Linker"
QGKCKKTCRDVFCPGSST

SEQ ID NO: 4338 - protein, 4 aa, Artificial Sequence
  source: /note="Description of Artificial Sequence: Synthetic Linker"
EEGL

SEQ ID NO: 4339 - protein, 4 aa, Artificial Sequence
  source: /note="Description of Artificial Sequence: Synthetic Linker"
FAGY

SEQ ID NO: 4340 - protein, 6 aa, Artificial Sequence
  source: /note="Description of Artificial Sequence: Synthetic Linker"
NKETRK

SEQ ID NO: 4341 - protein, 7 aa, Artificial Sequence
  source: /note="Description of Artificial Sequence: Synthetic Linker"
EKELYFK

SEQ ID NO: 4342 - protein, 7 aa, Artificial Sequence
  source: /note="Description of Artificial Sequence: Synthetic Linker"
FQGKIKG

SEQ ID NO: 4343 - protein, 7 aa, Artificial Sequence
  source: /note="Description of Artificial Sequence: Synthetic Linker"
MWPDADL

SEQ ID NO: 4344 - protein, 7 aa, Artificial Sequence
  source: /note="Description of Artificial Sequence: Synthetic Linker"
VGEGFAF

SEQ ID NO: 4345 - protein, 10 aa, Artificial Sequence
  source: /note="Description of Artificial Sequence: Synthetic Linker"
GTARASIPTY

SEQ ID NO: 4346 - protein, 13 aa, Artificial Sequence
  source: /note="Description of Artificial Sequence: Synthetic Linker"
FTPVSKDPQSANW

SEQ ID NO: 4347 - protein, 13 aa, Artificial Sequence
  source: /note="Description of Artificial Sequence: Synthetic Linker"
YLPKGEDGKDYSW

SEQ ID NO: 4348 - protein, 22 aa, Artificial Sequence
  source: /note="Description of Artificial Sequence: Synthetic Linker"
WGFERDENGNPKRDETLKHPRC

SEQ ID NO: 4349 - protein, 55 aa, Artificial Sequence
  source: /note="Description of Artificial Sequence: Synthetic Linker"
AYLYGPGREDGPLPEYYEPMECPVIEHPFSKTLHNPTALHFATEEKAVCDPRYPF

SEQ ID NO: 4350 - protein, 44 aa, Artificial Sequence
  source: /note="Description of Artificial Sequence: Synthetic Linker"
GRLFAINKMAEGPFPEHYEPIETPLGTNPLHPNVVSNPVVRLYE

SEQ ID NO: 4351 - protein, 4 aa, Artificial Sequence
  source: /note="Description of Artificial Sequence: Synthetic Linker"
AAQK

SEQ ID NO: 4352 - protein, 4 aa, Artificial Sequence
  source: /note="Description of Artificial Sequence: Synthetic Linker"
EDGL

SEQ ID NO: 4353 - protein, 4 aa, Artificial Sequence
  source: /note="Description of Artificial Sequence: Synthetic Linker"
FSGY

SEQ ID NO: 4354 - protein, 5 aa, Artificial Sequence
  source: /note="Description of Artificial Sequence: Synthetic Linker"
TNASL

SEQ ID NO: 4355 - protein, 6 aa, Artificial Sequence
  source: /note="Description of Artificial Sequence: Synthetic Linker"
DAEKRQ

SEQ ID NO: 4356 - protein, 7 aa, Artificial Sequence
  source: /note="Description of Artificial Sequence: Synthetic Linker"
DEGKVTG

SEQ ID NO: 4357 - protein, 7 aa, Artificial Sequence
  source: /note="Description of Artificial Sequence: Synthetic Linker"
ENNKINA

SEQ ID NO: 4358 - protein, 7 aa, Artificial Sequence
  source: /note="Description of Artificial Sequence: Synthetic Linker"
VRDDFAF

SEQ ID NO: 4359 - protein, 10 aa, Artificial Sequence
  source: /note="Description of Artificial Sequence: Synthetic Linker"
TLPSEKQVDL

SEQ ID NO: 4360 - protein, 11 aa, Artificial Sequence
  source: /note="Description of Artificial Sequence: Synthetic Linker"
WLPKWDQTYDV

SEQ ID NO: 4361 - protein, 12 aa, Artificial Sequence
  source: /note="Description of Artificial Sequence: Synthetic Linker"
ALRMGKKEQFPY

SEQ ID NO: 4362 - protein, 13 aa, Artificial Sequence
  source: /note="Description of Artificial Sequence: Synthetic Linker"
NTPKATLADQVNY

SEQ ID NO: 4363 - protein, 27 aa, Artificial Sequence
  source: /note="Description of Artificial Sequence: Synthetic Linker"
YDKSSWNYQLDENGYAKRDETLTHPRC

SEQ ID NO: 4364 - protein, 9 aa, Artificial Sequence
  source: /note="Description of Artificial Sequence: Synthetic Linker"
HLPATIGDY

SEQ ID NO: 4365 - protein, 4 aa, Artificial Sequence
  source: /note="Description of Artificial Sequence: Synthetic Linker"
SNRG

SEQ ID NO: 4366 - protein, 6 aa, Artificial Sequence
  source: /note="Description of Artificial Sequence: Synthetic Linker"
DAVKGK

SEQ ID NO: 4367 - protein, 7 aa, Artificial Sequence
  source: /note="Description of Artificial Sequence: Synthetic Linker"
LLPDGRV

SEQ ID NO: 4368 - protein, 7 aa, Artificial Sequence
  source: /note="Description of Artificial Sequence: Synthetic Linker"
MDGNGQI

SEQ ID NO: 4369 - protein, 7 aa, Artificial Sequence
  source: /note="Description of Artificial Sequence: Synthetic Linker"
QAGPSTA

SEQ ID NO: 4370 - protein, 7 aa, Artificial Sequence
  source: /note="Description of Artificial Sequence: Synthetic Linker"
SDNHAWL

SEQ ID NO: 4371 - protein, 7 aa, Artificial Sequence
  source: /note="Description of Artificial Sequence: Synthetic Linker"
VLPDGST

SEQ ID NO: 4372 - protein, 7 aa, Artificial Sequence
  source: /note="Description of Artificial Sequence: Synthetic Linker"
YNSNGNL

SEQ ID NO: 4373 - protein, 7 aa, Artificial Sequence
  source: /note="Description of Artificial Sequence: Synthetic Linker"
YTSGSGD

SEQ ID NO: 4374 - protein, 8 aa, Artificial Sequence
  source: /note="Description of Artificial Sequence: Synthetic Linker"
DLPIVPAA

SEQ ID NO: 4375 - protein, 8 aa, Artificial Sequence
  source: /note="Description of Artificial Sequence: Synthetic Linker"
IEPTSGRV

SEQ ID NO: 4376 - protein, 8 aa, Artificial Sequence
  source: /note="Description of Artificial Sequence: Synthetic Linker"
WDPSTGIV

SEQ ID NO: 4377 - protein, 9 aa, Artificial Sequence
  source: /note="Description of Artificial Sequence: Synthetic Linker"
EANGQPWTS

SEQ ID NO: 4378 - protein, 9 aa, Artificial Sequence
  source: /note="Description of Artificial Sequence: Synthetic Linker"
MLTADKQGL

SEQ ID NO: 4379 - protein, 9 aa, Artificial Sequence
  source: /note="Description of Artificial Sequence: Synthetic Linker"
VAPDAMCGN

SEQ ID NO: 4380 - protein, 10 aa, Artificial Sequence
  source: /note="Description of Artificial Sequence: Synthetic Linker"
TLGEPGTSPN

SEQ ID NO: 4381 - protein, 12 aa, Artificial Sequence
  source: /note="Description of Artificial Sequence: Synthetic Linker"
VTVTKHDMFCPG

SEQ ID NO: 4382 - protein, 13 aa, Artificial Sequence
  source: /note="Description of Artificial Sequence: Synthetic Linker"
KQNPNSIVRVYHS

SEQ ID NO: 4383 - protein, 14 aa, Artificial Sequence
  source: /note="Description of Artificial Sequence: Synthetic Linker"
FASNGLYFARTFHT

SEQ ID NO: 4384 - protein, 14 aa, Artificial Sequence
  source: /note="Description of Artificial Sequence: Synthetic Linker"
GGGLCGDCTTNHFD

SEQ ID NO: 4385 - protein, 14 aa, Artificial Sequence
  source: /note="Description of Artificial Sequence: Synthetic Linker"
QASSYTAPQPGLGR

SEQ ID NO: 4386 - protein, 16 aa, Artificial Sequence
  source: /note="Description of Artificial Sequence: Synthetic Linker"
FGGSPDYQDSDATTNA

SEQ ID NO: 4387 - protein, 17 aa, Artificial Sequence
  source: /note="Description of Artificial Sequence: Synthetic Linker"
WSSYRNDAFGGSPGGIT

SEQ ID NO: 4388 - protein, 20 aa, Artificial Sequence
  source: /note="Description of Artificial Sequence: Synthetic Linker"
TGGQRRGIPFEDSTPVFTPE

SEQ ID NO: 4389 - protein, 10 aa, Artificial Sequence
  source: /note="Description of Artificial Sequence: Synthetic Linker"
LIPQHTGTFR

SEQ ID NO: 4390 - protein, 11 aa, Artificial Sequence
  source: /note="Description of Artificial Sequence: Synthetic Linker"
EPRSQPHTKPS

SEQ ID NO: 4391 - protein, 4 aa, Artificial Sequence
  source: /note="Description of Artificial Sequence: Synthetic Linker"
KPAP

SEQ ID NO: 4392 - protein, 6 aa, Artificial Sequence
  source: /note="Description of Artificial Sequence: Synthetic Linker"
IEGANG

SEQ ID NO: 4393 - protein, 8 aa, Artificial Sequence
  source: /note="Description of Artificial Sequence: Synthetic Linker"
PIKNMPID

SEQ ID NO: 4394 - protein, 12 aa, Artificial Sequence
  source: /note="Description of Artificial Sequence: Synthetic Linker"
DQPTAHPTVRDE

SEQ ID NO: 4395 - protein, 8 aa, Artificial Sequence
  source: /note="Description of Artificial Sequence: Synthetic Linker"
LVRTLVPT

SEQ ID NO: 4396 - protein, 9 aa, Artificial Sequence
  source: /note="Description of Artificial Sequence: Synthetic Linker"
AGAPVETPQ

SEQ ID NO: 4397 - protein, 11 aa, Artificial Sequence
  source: /note="Description of Artificial Sequence: Synthetic Linker"
SLDAPATSLTG

SEQ ID NO: 4398 - protein, 12 aa, Artificial Sequence
  source: /note="Description of Artificial Sequence: Synthetic Linker"
YAAGTPLSSPEL

SEQ ID NO: 4399 - protein, 4 aa, Artificial Sequence
  source: /note="Description of Artificial Sequence: Synthetic Linker"
KVEH

SEQ ID NO: 4400 - protein, 4 aa, Artificial Sequence
  source: /note="Description of Artificial Sequence: Synthetic Linker"
SHGQ

SEQ ID NO: 4401 - protein, 4 aa, Artificial Sequence
  source: /note="Description of Artificial Sequence: Synthetic Linker"
VDLS

SEQ ID NO: 4402 - protein, 5 aa, Artificial Sequence
  source: /note="Description of Artificial Sequence: Synthetic Linker"
KGLDA

SEQ ID NO: 4403 - protein, 5 aa, Artificial Sequence
  source: /note="Description of Artificial Sequence: Synthetic Linker"
LGPNA

SEQ ID NO: 4404 - protein, 5 aa, Artificial Sequence
  source: /note="Description of Artificial Sequence: Synthetic Linker"
LTGRI

SEQ ID NO: 4405 - protein, 6 aa, Artificial Sequence
  source: /note="Description of Artificial Sequence: Synthetic Linker"
ITRRSV

SEQ ID NO: 4406 - protein, 6 aa, Artificial Sequence
  source: /note="Description of Artificial Sequence: Synthetic Linker"
VKRQDI

SEQ ID NO: 4407 - protein, 7 aa, Artificial Sequence
  source: /note="Description of Artificial Sequence: Synthetic Linker"
FDKTGAE

SEQ ID NO: 4408 - protein, 17 aa, Artificial Sequence
  source: /note="Description of Artificial Sequence: Synthetic Linker"
ESNLQYDAGDKGIYRHY

SEQ ID NO: 4409 - protein, 5 aa, Artificial Sequence
  source: /note="Description of Artificial Sequence: Synthetic Linker"
DIGTI

SEQ ID NO: 4410 - protein, 27 aa, Artificial Sequence
  source: /note="Description of Artificial Sequence: Synthetic Linker"
TKKPVPDFSFYDRSAPIYTQPRYLPPS

SEQ ID NO: 4411 - protein, 4 aa, Artificial Sequence
  source: /note="Description of Artificial Sequence: Synthetic Linker"
KTPL

SEQ ID NO: 4412 - protein, 7 aa, Artificial Sequence
  source: /note="Description of Artificial Sequence: Synthetic Linker"
NCYGCET

SEQ ID NO: 4413 - protein, 16 aa, Artificial Sequence
  source: /note="Description of Artificial Sequence: Synthetic Linker"
YGIDVKIPEGLEPPNE

SEQ ID NO: 4414 - protein, 6 aa, Artificial Sequence
  source: /note="Description of Artificial Sequence: Synthetic Linker"
VGGFYN

SEQ ID NO: 4415 - protein, 7 aa, Artificial Sequence
  source: /note="Description of Artificial Sequence: Synthetic Linker"
VLTGKAR

SEQ ID NO: 4416 - protein, 14 aa, Artificial Sequence
  source: /note="Description of Artificial Sequence: Synthetic Linker"
FDVAESVIPSSGTF

SEQ ID NO: 4417 - protein, 5 aa, Artificial Sequence
  source: /note="Description of Artificial Sequence: Synthetic Linker"
TLKPW

SEQ ID NO: 4418 - protein, 9 aa, Artificial Sequence
  source: /note="Description of Artificial Sequence: Synthetic Linker"
VQNTTHLDE

SEQ ID NO: 4419 - protein, 11 aa, Artificial Sequence
  source: /note="Description of Artificial Sequence: Synthetic Linker"
LKGEPSDMDKA

SEQ ID NO: 4420 - protein, 14 aa, Artificial Sequence
  source: /note="Description of Artificial Sequence: Synthetic Linker"
HFPAMVSRISGIGL

SEQ ID NO: 4421 - protein, 15 aa, Artificial Sequence
  source: /note="Description of Artificial Sequence: Synthetic Linker"
QVSRGAEHLDDLDLN

SEQ ID NO: 4422 - protein, 26 aa, Artificial Sequence
  source: /note="Description of Artificial Sequence: Synthetic Linker"
LAQVDPGENARYCTLQGRNEVPDTLD

SEQ ID NO: 4423 - protein, 27 aa, Artificial Sequence
  source: /note="Description of Artificial Sequence: Synthetic Linker"
YNEEVVALPVGGFYRFRKSGDRHGWEG

SEQ ID NO: 4424 - protein, 13 aa, Artificial Sequence
  source: /note="Description of Artificial Sequence: Synthetic Linker"
HDPFTLEPYSRDP

SEQ ID NO: 4425 - protein, 13 aa, Artificial Sequence
  source: /note="Description of Artificial Sequence: Synthetic Linker"
YTPAGEPIPTNKR

SEQ ID NO: 4426 - protein, 4 aa, Artificial Sequence
  source: /note="Description of Artificial Sequence: Synthetic Linker"
NIPP

SEQ ID NO: 4427 - protein, 4 aa, Artificial Sequence
  source: /note="Description of Artificial Sequence: Synthetic Linker"
RGWA

SEQ ID NO: 4428 - protein, 5 aa, Artificial Sequence
  source: /note="Description of Artificial Sequence: Synthetic Linker"
AFETP

SEQ ID NO: 4429 - protein, 5 aa, Artificial Sequence
  source: /note="Description of Artificial Sequence: Synthetic Linker"
DELRG

SEQ ID NO: 4430 - protein, 6 aa, Artificial Sequence
  source: /note="Description of Artificial Sequence: Synthetic Linker"
EIPDVV

SEQ ID NO: 4431 - protein, 7 aa, Artificial Sequence
  source: /note="Description of Artificial Sequence: Synthetic Linker"
KGGYDGR

SEQ ID NO: 4432 - protein, 7 aa, Artificial Sequence
  source: /note="Description of Artificial Sequence: Synthetic Linker"
RRGEPHV

SEQ ID NO: 4433 - protein, 8 aa, Artificial Sequence
  source: /note="Description of Artificial Sequence: Synthetic Linker"
LKVPRPGT

SEQ ID NO: 4434 - protein, 14 aa, Artificial Sequence
  source: /note="Description of Artificial Sequence: Synthetic Linker"
NLDGKPLLTGKRNP

SEQ ID NO: 4435 - protein, 6 aa, Artificial Sequence
  source: /note="Description of Artificial Sequence: Synthetic Linker"
DHSDVA

SEQ ID NO: 4436 - protein, 8 aa, Artificial Sequence
  source: /note="Description of Artificial Sequence: Synthetic Linker"
FKPAYGSI

SEQ ID NO: 4437 - protein, 19 aa, Artificial Sequence
  source: /note="Description of Artificial Sequence: Synthetic Linker"
AFPGTPHLLPPANSGDADA

SEQ ID NO: 4438 - protein, 12 aa, Artificial Sequence
  source: /note="Description of Artificial Sequence: Synthetic Linker"
YGKDDKLYPKDP

SEQ ID NO: 4439 - protein, 9 aa, Artificial Sequence
  source: /note="Description of Artificial Sequence: Synthetic Linker"
KYNLYGKDI

SEQ ID NO: 4440 - protein, 6 aa, Artificial Sequence
  source: /note="Description of Artificial Sequence: Synthetic Linker"
LREGNL

SEQ ID NO: 4441 - protein, 6 aa, Artificial Sequence
  source: /note="Description of Artificial Sequence: Synthetic Linker"
DCNEKL

SEQ ID NO: 4442 - protein, 6 aa, Artificial Sequence
  source: /note="Description of Artificial Sequence: Synthetic Linker"
LYPSDP

SEQ ID NO: 4443 - protein, 6 aa, Artificial Sequence
  source: /note="Description of Artificial Sequence: Synthetic Linker"
YGAHDA

SEQ ID NO: 4444 - protein, 9 aa, Artificial Sequence
  source: /note="Description of Artificial Sequence: Synthetic Linker"
QFKMMGETD

SEQ ID NO: 4445 - protein, 6 aa, Artificial Sequence
  source: /note="Description of Artificial Sequence: Synthetic Linker"
FETEYF

SEQ ID NO: 4446 - protein, 11 aa, Artificial Sequence
  source: /note="Description of Artificial Sequence: Synthetic Linker"
TSPHDHQTHAY

SEQ ID NO: 4447 - protein, 9 aa, Artificial Sequence
  source: /note="Description of Artificial Sequence: Synthetic Linker"
KADPKGITE

SEQ ID NO: 4448 - protein, 34 aa, Artificial Sequence
  source: /note="Description of Artificial Sequence: Synthetic Linker"
LTAKEPTEVESVECPHIAVGVWEANEKLPETPDR

SEQ ID NO: 4449 - protein, 4 aa, Artificial Sequence
  source: /note="Description of Artificial Sequence: Synthetic Linker"
VVPN

SEQ ID NO: 4450 - protein, 5 aa, Artificial Sequence
  source: /note="Description of Artificial Sequence: Synthetic Linker"
LSPPV

SEQ ID NO: 4451 - protein, 7 aa, Artificial Sequence
  source: /note="Description of Artificial Sequence: Synthetic Linker"
DVKNGEC

SEQ ID NO: 4452 - protein, 7 aa, Artificial Sequence
  source: /note="Description of Artificial Sequence: Synthetic Linker"
KDDIVDR

SEQ ID NO: 4453 - protein, 7 aa, Artificial Sequence
  source: /note="Description of Artificial Sequence: Synthetic Linker"
SDKKCSV

SEQ ID NO: 4454 - protein, 7 aa, Artificial Sequence
  source: /note="Description of Artificial Sequence: Synthetic Linker"
TKVPLVA

SEQ ID NO: 4455 - protein, 9 aa, Artificial Sequence
  source: /note="Description of Artificial Sequence: Synthetic Linker"
LAQLDNYGQ

SEQ ID NO: 4456 - protein, 12 aa, Artificial Sequence
  source: /note="Description of Artificial Sequence: Synthetic Linker"
NYNVKSPITGND

SEQ ID NO: 4457 - protein, 85 aa, Artificial Sequence
  source: /note="Description of Artificial Sequence: Synthetic Linker"
KPLKEPKTVNVVQFEPSKGAIGKAYKKDAKLVMEYLAICDECYITEMEMLLNEKGEFTIETEGKTFQLTKDMINVKRFQKTLYVE

SEQ ID NO: 4458 - protein, 4 aa, Artificial Sequence
  source: /note="Description of Artificial Sequence: Synthetic Linker"
SNGG

SEQ ID NO: 4459 - protein, 13 aa, Artificial Sequence
  source: /note="Description of Artificial Sequence: Synthetic Linker"
FSVDEIVQPDPPI

SEQ ID NO: 4460 - protein, 10 aa, Artificial Sequence
  source: /note="Description of Artificial Sequence: Synthetic Linker"
LTPRRSRKLK

SEQ ID NO: 4461 - protein, 6 aa, Artificial Sequence
  source: /note="Description of Artificial Sequence: Synthetic Linker"
DEPRSV

SEQ ID NO: 4462 - protein, 29 aa, Artificial Sequence
  source: /note="Description of Artificial Sequence: Synthetic Linker"
LPTANGDGGALALDSLTVLGAGGNNANDW

SEQ ID NO: 4463 - protein, 6 aa, Artificial Sequence
  source: /note="Description of Artificial Sequence: Synthetic Linker"
RNNLTR

SEQ ID NO: 4464 - protein, 8 aa, Artificial Sequence
  source: /note="Description of Artificial Sequence: Synthetic Linker"
RAMTDVHQ

SEQ ID NO: 4465 - protein, 24 aa, Artificial Sequence
  source: /note="Description of Artificial Sequence: Synthetic Linker"
TTENPELQLEPLSAPEVTEPTATD

SEQ ID NO: 4466 - protein, 6 aa, Artificial Sequence
  source: /note="Description of Artificial Sequence: Synthetic Linker"
VPRDCG

SEQ ID NO: 4467 - protein, 7 aa, Artificial Sequence
  source: /note="Description of Artificial Sequence: Synthetic Linker"
VRSRGPE

SEQ ID NO: 4468 - protein, 40 aa, Artificial Sequence
  source: /note="Description of Artificial Sequence: Synthetic Linker"
QEPEFQRMSALRLAACKRKEQEHGKDRGNTPKKPRLVFTD

SEQ ID NO: 4469 - protein, 14 aa, Artificial Sequence
  source: /note="Description of Artificial Sequence: Synthetic Linker"
AEGFGLPEEKGPDL

SEQ ID NO: 4470 - protein, 4 aa, Artificial Sequence
  source: /note="Description of Artificial Sequence: Synthetic Linker"
KGGK

SEQ ID NO: 4471 - protein, 6 aa, Artificial Sequence
  source: /note="Description of Artificial Sequence: Synthetic Linker"
KNQKPI

SEQ ID NO: 4472 - protein, 7 aa, Artificial Sequence
  source: /note="Description of Artificial Sequence: Synthetic Linker"
RGTLNVS

SEQ ID NO: 4473 - protein, 9 aa, Artificial Sequence
  source: /note="Description of Artificial Sequence: Synthetic Linker"
TVGAGLPII

SEQ ID NO: 4474 - protein, 4 aa, Artificial Sequence
  source: /note="Description of Artificial Sequence: Synthetic Linker"
LDGE

SEQ ID NO: 4475 - protein, 4 aa, Artificial Sequence
  source: /note="Description of Artificial Sequence: Synthetic Linker"
LGNW

SEQ ID NO: 4476 - protein, 7 aa, Artificial Sequence
  source: /note="Description of Artificial Sequence: Synthetic Linker"
HLFPDCA

SEQ ID NO: 4477 - protein, 18 aa, Artificial Sequence
  source: /note="Description of Artificial Sequence: Synthetic Linker"
IPKAELLTSESRGVLPDT

SEQ ID NO: 4478 - protein, 5 aa, Artificial Sequence
  source: /note="Description of Artificial Sequence: Synthetic Linker"
ETVAP

SEQ ID NO: 4479 - protein, 6 aa, Artificial Sequence
  source: /note="Description of Artificial Sequence: Synthetic Linker"
QGLTSF

SEQ ID NO: 4480 - protein, 7 aa, Artificial Sequence
  source: /note="Description of Artificial Sequence: Synthetic Linker"
VSKPKME

SEQ ID NO: 4481 - protein, 5 aa, Artificial Sequence
  source: /note="Description of Artificial Sequence: Synthetic Linker"
TVAAP

SEQ ID NO: 4482 - protein, 26 aa, Artificial Sequence
  source: /note="Description of Artificial Sequence: Synthetic Linker"
GGNPPGGNRGTTTTRRPATTTGSSPG

SEQ ID NO: 4483 - protein, 7 aa, Artificial Sequence
  source: /note="Description of Artificial Sequence: Synthetic Linker"
CKPCICT

SEQ ID NO: 4484 - protein, 6 aa, Artificial Sequence
  source: /note="Description of Artificial Sequence: Synthetic Linker"
VPSEVS

SEQ ID NO: 4485 - protein, 10 aa, Artificial Sequence
  source: /note="Description of Artificial Sequence: Synthetic Linker"
EPKSCDKTHT

SEQ ID NO: 4486 - protein, 7 aa, Artificial Sequence
  source: /note="Description of Artificial Sequence: Synthetic Linker"
CPPCKCP

SEQ ID NO: 4487 - protein, 9 aa, Artificial Sequence
  source: /note="Description of Artificial Sequence: Synthetic Linker"
EPRGPTIKP

SEQ ID NO: 4488 - protein, 5 aa, Artificial Sequence
  source: /note="Description of Artificial Sequence: Synthetic Linker"
ATENE

SEQ ID NO: 4489 - protein, 6 aa, Artificial Sequence
  source: /note="Description of Artificial Sequence: Synthetic Linker"
AKSVGI

SEQ ID NO: 4490 - protein, 7 aa, Artificial Sequence
  source: /note="Description of Artificial Sequence: Synthetic Linker"
ATWTGDS

SEQ ID NO: 4491 - protein, 10 aa, Artificial Sequence
  source: /note="Description of Artificial Sequence: Synthetic Linker"
ATITNANWDD

SEQ ID NO: 4492 - protein, 11 aa, Artificial Sequence
  source: /note="Description of Artificial Sequence: Synthetic Linker"
NGKDFSEPLPE

SEQ ID NO: 4493 - protein, 6 aa, Artificial Sequence
  source: /note="Description of Artificial Sequence: Synthetic Linker"
KQPLRR

SEQ ID NO: 4494 - protein, 8 aa, Artificial Sequence
  source: /note="Description of Artificial Sequence: Synthetic Linker"
LSPYTESS

SEQ ID NO: 4495 - protein, 4 aa, Artificial Sequence
  source: /note="Description of Artificial Sequence: Synthetic Linker"
VDSE

SEQ ID NO: 4496 - protein, 5 aa, Artificial Sequence
  source: /note="Description of Artificial Sequence: Synthetic Linker"
FVTGP

SEQ ID NO: 4497 - protein, 7 aa, Artificial Sequence
  source: /note="Description of Artificial Sequence: Synthetic Linker"
IKGDAYY

SEQ ID NO: 4498 - protein, 8 aa, Artificial Sequence
  source: /note="Description of Artificial Sequence: Synthetic Linker"
TKSGVVHF

SEQ ID NO: 4499 - protein, 9 aa, Artificial Sequence
  source: /note="Description of Artificial Sequence: Synthetic Linker"
VVLGEEVSF

SEQ ID NO: 4500 - protein, 12 aa, Artificial Sequence
  source: /note="Description of Artificial Sequence: Synthetic Linker"
IVPNDAAKPYNM

SEQ ID NO: 4501 - protein, 26 aa, Artificial Sequence
  source: /note="Description of Artificial Sequence: Synthetic Linker"
YLPSNNMEEPPYIDTGDPADRDATGV

SEQ ID NO: 4502 - protein, 4 aa, Artificial Sequence
  source: /note="Description of Artificial Sequence: Synthetic Linker"
GALP

SEQ ID NO: 4503 - protein, 8 aa, Artificial Sequence
  source: /note="Description of Artificial Sequence: Synthetic Linker"
FGVDWLKG

SEQ ID NO: 4504 - protein, 4 aa, Artificial Sequence
  source: /note="Description of Artificial Sequence: Synthetic Linker"
ILPQ

SEQ ID NO: 4505 - protein, 7 aa, Artificial Sequence
  source: /note="Description of Artificial Sequence: Synthetic Linker"
EAPLDNS

SEQ ID NO: 4506 - protein, 14 aa, Artificial Sequence
  source: /note="Description of Artificial Sequence: Synthetic Linker"
AAERVPLANPFAGE

SEQ ID NO: 4507 - protein, 4 aa, Artificial Sequence
  source: /note="Description of Artificial Sequence: Synthetic Linker"
EGVL

SEQ ID NO: 4508 - protein, 6 aa, Artificial Sequence
  source: /note="Description of Artificial Sequence: Synthetic Linker"
LVKIEP

SEQ ID NO: 4509 - protein, 6 aa, Artificial Sequence
  source: /note="Description of Artificial Sequence: Synthetic Linker"
RSLIGD

SEQ ID NO: 4510 - protein, 7 aa, Artificial Sequence
  source: /note="Description of Artificial Sequence: Synthetic Linker"
DASAVHP

SEQ ID NO: 4511 - protein, 7 aa, Artificial Sequence
  source: /note="Description of Artificial Sequence: Synthetic Linker"
EFPELDV

SEQ ID NO: 4512 - protein, 7 aa, Artificial Sequence
  source: /note="Description of Artificial Sequence: Synthetic Linker"
FSDYFEH

SEQ ID NO: 4513 - protein, 7 aa, Artificial Sequence
  source: /note="Description of Artificial Sequence: Synthetic Linker"
KVSRLGE

SEQ ID NO: 4514 - protein, 7 aa, Artificial Sequence
  source: /note="Description of Artificial Sequence: Synthetic Linker"
NGAFRTR

SEQ ID NO: 4515 - protein, 7 aa, Artificial Sequence
  source: /note="Description of Artificial Sequence: Synthetic Linker"
PLKSAPS

SEQ ID NO: 4516 - protein, 8 aa, Artificial Sequence
  source: /note="Description of Artificial Sequence: Synthetic Linker"
ARISGLNS

SEQ ID NO: 4517 - protein, 10 aa, Artificial Sequence
  source: /note="Description of Artificial Sequence: Synthetic Linker"
QRIAADTERD

SEQ ID NO: 4518 - protein, 11 aa, Artificial Sequence
  source: /note="Description of Artificial Sequence: Synthetic Linker"
ERFGLSNQGRA

SEQ ID NO: 4519 - protein, 11 aa, Artificial Sequence
  source: /note="Description of Artificial Sequence: Synthetic Linker"
LLAAPAGPRAT

SEQ ID NO: 4520 - protein, 12 aa, Artificial Sequence
  source: /note="Description of Artificial Sequence: Synthetic Linker"
KVGEEAPGTLHP

SEQ ID NO: 4521 - protein, 12 aa, Artificial Sequence
  source: /note="Description of Artificial Sequence: Synthetic Linker"
NAVGVDVNTASA

SEQ ID NO: 4522 - protein, 13 aa, Artificial Sequence
  source: /note="Description of Artificial Sequence: Synthetic Linker"
AAGFLRVMNGDNP

SEQ ID NO: 4523 - protein, 13 aa, Artificial Sequence
  source: /note="Description of Artificial Sequence: Synthetic Linker"
GVESLKDLKPGMV

SEQ ID NO: 4524 - protein, 13 aa, Artificial Sequence
  source: /note="Description of Artificial Sequence: Synthetic Linker"
SIGVGQYQHDVSQ

SEQ ID NO: 4525 - protein, 17 aa, Artificial Sequence
  source: /note="Description of Artificial Sequence: Synthetic Linker"
LDKPGRDPRPEFKTAEF

SEQ ID NO: 4526 - protein, 23 aa, Artificial Sequence
  source: /note="Description of Artificial Sequence: Synthetic Linker"
LKRLDPKKFTDETFGLPTVTDIL

SEQ ID NO: 4527 - protein, 4 aa, Artificial Sequence
  source: /note="Description of Artificial Sequence: Synthetic Linker"
LEGE

SEQ ID NO: 4528 - protein, 5 aa, Artificial Sequence
  source: /note="Description of Artificial Sequence: Synthetic Linker"
RLGFK

SEQ ID NO: 4529 - protein, 9 aa, Artificial Sequence
  source: /note="Description of Artificial Sequence: Synthetic Linker"
RGRPFEPPV

SEQ ID NO: 4530 - protein, 15 aa, Artificial Sequence
  source: /note="Description of Artificial Sequence: Synthetic Linker"
RGEVEETLKEDLPNV

SEQ ID NO: 4531 - protein, 4 aa, Artificial Sequence
  source: /note="Description of Artificial Sequence: Synthetic Linker"
LEYE

SEQ ID NO: 4532 - protein, 9 aa, Artificial Sequence
  source: /note="Description of Artificial Sequence: Synthetic Linker"
SYGLPPLNA

SEQ ID NO: 4533 - protein, 5 aa, Artificial Sequence
  source: /note="Description of Artificial Sequence: Synthetic Linker"
ILHDE

SEQ ID NO: 4534 - protein, 13 aa, Artificial Sequence
  source: /note="Description of Artificial Sequence: Synthetic Linker"
KGWGGLPIGTEGR

SEQ ID NO: 4535 - protein, 4 aa, Artificial Sequence
  source: /note="Description of Artificial Sequence: Synthetic Linker"
PQSP

SEQ ID NO: 4536 - protein, 6 aa, Artificial Sequence
  source: /note="Description of Artificial Sequence: Synthetic Linker"
DGFEAL

SEQ ID NO: 4537 - protein, 6 aa, Artificial Sequence
  source: /note="Description of Artificial Sequence: Synthetic Linker"
EQNPWK

SEQ ID NO: 4538 - protein, 6 aa, Artificial Sequence
  source: /note="Description of Artificial Sequence: Synthetic Linker"
SEHWQR

SEQ ID NO: 4539 - protein, 9 aa, Artificial Sequence
  source: /note="Description of Artificial Sequence: Synthetic Linker"
LDPQACPTV

SEQ ID NO: 4540 - protein, 5 aa, Artificial Sequence
  source: /note="Description of Artificial Sequence: Synthetic Linker"
KTPLT

SEQ ID NO: 4541 - protein, 6 aa, Artificial Sequence
  source: /note="Description of Artificial Sequence: Synthetic Linker"
LRQLTT

SEQ ID NO: 4542 - protein, 4 aa, Artificial Sequence
  source: /note="Description of Artificial Sequence: Synthetic Linker"
QNDI

SEQ ID NO: 4543 - protein, 7 aa, Artificial Sequence
  source: /note="Description of Artificial Sequence: Synthetic Linker"
INARAPV

SEQ ID NO: 4544 - protein, 9 aa, Artificial Sequence
  source: /note="Description of Artificial Sequence: Synthetic Linker"
TVTHGDIDL

SEQ ID NO: 4545 - protein, 10 aa, Artificial Sequence
  source: /note="Description of Artificial Sequence: Synthetic Linker"
TKTDVAGEAE

SEQ ID NO: 4546 - protein, 24 aa, Artificial Sequence
  source: /note="Description of Artificial Sequence: Synthetic Linker"
LFNTNGFMLEENVVSTKPRFHFIA

SEQ ID NO: 4547 - protein, 7 aa, Artificial Sequence
  source: /note="Description of Artificial Sequence: Synthetic Linker"
ASLDQPF

SEQ ID NO: 4548 - protein, 9 aa, Artificial Sequence
  source: /note="Description of Artificial Sequence: Synthetic Linker"
VKPGRQYQE

SEQ ID NO: 4549 - protein, 4 aa, Artificial Sequence
  source: /note="Description of Artificial Sequence: Synthetic Linker"
DGFE

SEQ ID NO: 4550 - protein, 5 aa, Artificial Sequence
  source: /note="Description of Artificial Sequence: Synthetic Linker"
LRRFN

SEQ ID NO: 4551 - protein, 6 aa, Artificial Sequence
  source: /note="Description of Artificial Sequence: Synthetic Linker"
KRTGET

SEQ ID NO: 4552 - protein, 16 aa, Artificial Sequence
  source: /note="Description of Artificial Sequence: Synthetic Linker"
VEGEQSIPMVSRLGMK

SEQ ID NO: 4553 - protein, 22 aa, Artificial Sequence
  source: /note="Description of Artificial Sequence: Synthetic Linker"
AEGHITTNHVAATRAAKSKVRR

SEQ ID NO: 4554 - protein, 8 aa, Artificial Sequence
  source: /note="Description of Artificial Sequence: Synthetic Linker"
VDKSDEPL

SEQ ID NO: 4555 - protein, 7 aa, Artificial Sequence
  source: /note="Description of Artificial Sequence: Synthetic Linker"
IVSPANE

SEQ ID NO: 4556 - protein, 11 aa, Artificial Sequence
  source: /note="Description of Artificial Sequence: Synthetic Linker"
VENEPNLCYNA

SEQ ID NO: 4557 - protein, 13 aa, Artificial Sequence
  source: /note="Description of Artificial Sequence: Synthetic Linker"
FITLEENKPTRPV

SEQ ID NO: 4558 - protein, 4 aa, Artificial Sequence
  source: /note="Description of Artificial Sequence: Synthetic Linker"
EDGI

SEQ ID NO: 4559 - protein, 4 aa, Artificial Sequence
  source: /note="Description of Artificial Sequence: Synthetic Linker"
HKLK

SEQ ID NO: 4560 - protein, 4 aa, Artificial Sequence
  source: /note="Description of Artificial Sequence: Synthetic Linker"
KGGE

SEQ ID NO: 4561 - protein, 4 aa, Artificial Sequence
  source: /note="Description of Artificial Sequence: Synthetic Linker"
SHSL

SEQ ID NO: 4562 - protein, 6 aa, Artificial Sequence
  source: /note="Description of Artificial Sequence: Synthetic Linker"
WSTDIL

SEQ ID NO: 4563 - protein, 9 aa, Artificial Sequence
  source: /note="Description of Artificial Sequence: Synthetic Linker"
DIIKPDPPK

SEQ ID NO: 4564 - protein, 13 aa, Artificial Sequence
  source: /note="Description of Artificial Sequence: Synthetic Linker"
KDQKEPKNKTFLR

SEQ ID NO: 4565 - protein, 7 aa, Artificial Sequence
  source: /note="Description of Artificial Sequence: Synthetic Linker"
WDNQCQC

SEQ ID NO: 4566 - protein, 42 aa, Artificial Sequence
  source: /note="Description of Artificial Sequence: Synthetic Linker"
SSATRSTTKQVTPQPEEQKERKTTEMQSPMQPVDQASLPGHC

SEQ ID NO: 4567 - protein, 5 aa, Artificial Sequence
  source: /note="Description of Artificial Sequence: Synthetic Linker"
LNKPI

SEQ ID NO: 4568 - protein, 5 aa, Artificial Sequence
  source: /note="Description of Artificial Sequence: Synthetic Linker"
NHQSN

SEQ ID NO: 4569 - protein, 5 aa, Artificial Sequence
  source: /note="Description of Artificial Sequence: Synthetic Linker"
NSIDQ

SEQ ID NO: 4570 - protein, 7 aa, Artificial Sequence
  source: /note="Description of Artificial Sequence: Synthetic Linker"
YLPNVTK

SEQ ID NO: 4571 - protein, 9 aa, Artificial Sequence
  source: /note="Description of Artificial Sequence: Synthetic Linker"
LANLKNLGW

SEQ ID NO: 4572 - protein, 9 aa, Artificial Sequence
  source: /note="Description of Artificial Sequence: Synthetic Linker"
LKDLKKLKS

SEQ ID NO: 4573 - protein, 10 aa, Artificial Sequence
  source: /note="Description of Artificial Sequence: Synthetic Linker"
FLDENKVKDL

SEQ ID NO: 4574 - protein, 10 aa, Artificial Sequence
  source: /note="Description of Artificial Sequence: Synthetic Linker"
NLKKKSVTDA

SEQ ID NO: 4575 - protein, 11 aa, Artificial Sequence
  source: /note="Description of Artificial Sequence: Synthetic Linker"
FLNGNKLTDIK

SEQ ID NO: 4576 - protein, 11 aa, Artificial Sequence
  source: /note="Description of Artificial Sequence: Synthetic Linker"
PNTVKNTDGSL

SEQ ID NO: 4577 - protein, 11 aa, Artificial Sequence
  source: /note="Description of Artificial Sequence: Synthetic Linker"
SLEHNGISDIN

SEQ ID NO: 4578 - protein, 13 aa, Artificial Sequence
  source: /note="Description of Artificial Sequence: Synthetic Linker"
IANNSDIKSVQGI

SEQ ID NO: 4579 - protein, 5 aa, Artificial Sequence
  source: /note="Description of Artificial Sequence: Synthetic Linker"
FTTLT

SEQ ID NO: 4580 - protein, 5 aa, Artificial Sequence
  source: /note="Description of Artificial Sequence: Synthetic Linker"
KAPEV

SEQ ID NO: 4581 - protein, 9 aa, Artificial Sequence
  source: /note="Description of Artificial Sequence: Synthetic Linker"
VSDVAVDVV

SEQ ID NO: 4582 - protein, 6 aa, Artificial Sequence
  source: /note="Description of Artificial Sequence: Synthetic Linker"
INTSYF

SEQ ID NO: 4583 - protein, 22 aa, Artificial Sequence
  source: /note="Description of Artificial Sequence: Synthetic Linker"
SGIISLEDLPDYTRSDEPLNSI

SEQ ID NO: 4584 - protein, 4 aa, Artificial Sequence
  source: /note="Description of Artificial Sequence: Synthetic Linker"
VNGQ

SEQ ID NO: 4585 - protein, 5 aa, Artificial Sequence
  source: /note="Description of Artificial Sequence: Synthetic Linker"
FKNAT

SEQ ID NO: 4586 - protein, 5 aa, Artificial Sequence
  source: /note="Description of Artificial Sequence: Synthetic Linker"
FYPNR

SEQ ID NO: 4587 - protein, 5 aa, Artificial Sequence
  source: /note="Description of Artificial Sequence: Synthetic Linker"
MDNDV

SEQ ID NO: 4588 - protein, 6 aa, Artificial Sequence
  source: /note="Description of Artificial Sequence: Synthetic Linker"
FPVPTL

SEQ ID NO: 4589 - protein, 6 aa, Artificial Sequence
  source: /note="Description of Artificial Sequence: Synthetic Linker"
VNDQGQ

SEQ ID NO: 4590 - protein, 7 aa, Artificial Sequence
  source: /note="Description of Artificial Sequence: Synthetic Linker"
SSFTPNV

SEQ ID NO: 4591 - protein, 7 aa, Artificial Sequence
  source: /note="Description of Artificial Sequence: Synthetic Linker"
VKGTIAA

SEQ ID NO: 4592 - protein, 8 aa, Artificial Sequence
  source: /note="Description of Artificial Sequence: Synthetic Linker"
SKKFPSYS

SEQ ID NO: 4593 - protein, 9 aa, Artificial Sequence
  source: /note="Description of Artificial Sequence: Synthetic Linker"
ITYQTYSEV

SEQ ID NO: 4594 - protein, 10 aa, Artificial Sequence
  source: /note="Description of Artificial Sequence: Synthetic Linker"
FATDKGFPKT

SEQ ID NO: 4595 - protein, 12 aa, Artificial Sequence
  source: /note="Description of Artificial Sequence: Synthetic Linker"
TADPIPDAGRSS

SEQ ID NO: 4596 - protein, 4 aa, Artificial Sequence
  source: /note="Description of Artificial Sequence: Synthetic Linker"
EKCF

SEQ ID NO: 4597 - protein, 4 aa, Artificial Sequence
  source: /note="Description of Artificial Sequence: Synthetic Linker"
KNGK

SEQ ID NO: 4598 - protein, 5 aa, Artificial Sequence
  source: /note="Description of Artificial Sequence: Synthetic Linker"
EKSHM

SEQ ID NO: 4599 - protein, 5 aa, Artificial Sequence
  source: /note="Description of Artificial Sequence: Synthetic Linker"
NTNSD

SEQ ID NO: 4600 - protein, 6 aa, Artificial Sequence
  source: /note="Description of Artificial Sequence: Synthetic Linker"
NAPEKH

SEQ ID NO: 4601 - protein, 7 aa, Artificial Sequence
  source: /note="Description of Artificial Sequence: Synthetic Linker"
ACPVAAL

SEQ ID NO: 4602 - protein, 7 aa, Artificial Sequence
  source: /note="Description of Artificial Sequence: Synthetic Linker"
DERSKSL

SEQ ID NO: 4603 - protein, 7 aa, Artificial Sequence
  source: /note="Description of Artificial Sequence: Synthetic Linker"
KCLLCGR

SEQ ID NO: 4604 - protein, 7 aa, Artificial Sequence
  source: /note="Description of Artificial Sequence: Synthetic Linker"
TETYAMK

SEQ ID NO: 4605 - protein, 9 aa, Artificial Sequence
  source: /note="Description of Artificial Sequence: Synthetic Linker"
DTNCLLCGQ

SEQ ID NO: 4606 - protein, 10 aa, Artificial Sequence
  source: /note="Description of Artificial Sequence: Synthetic Linker"
NGGGQPHVNP

SEQ ID NO: 4607 - protein, 14 aa, Artificial Sequence
  source: /note="Description of Artificial Sequence: Synthetic Linker"
YKARASKPFLPKDK

SEQ ID NO: 4608 - protein, 18 aa, Artificial Sequence
  source: /note="Description of Artificial Sequence: Synthetic Linker"
LDIHEFKCGPCNRRENCE

SEQ ID NO: 4609 - protein, 6 aa, Artificial Sequence
  source: /note="Description of Artificial Sequence: Synthetic Linker"
VVGGEL

SEQ ID NO: 4610 - protein, 5 aa, Artificial Sequence
  source: /note="Description of Artificial Sequence: Synthetic Linker"
HNGFF

SEQ ID NO: 4611 - protein, 11 aa, Artificial Sequence
  source: /note="Description of Artificial Sequence: Synthetic Linker"
VKGKEGDEEEE

SEQ ID NO: 4612 - protein, 4 aa, Artificial Sequence
  source: /note="Description of Artificial Sequence: Synthetic Linker"
KLIV

SEQ ID NO: 4613 - protein, 6 aa, Artificial Sequence
  source: /note="Description of Artificial Sequence: Synthetic Linker"
TIGNRA

SEQ ID NO: 4614 - protein, 13 aa, Artificial Sequence
  source: /note="Description of Artificial Sequence: Synthetic Linker"
VPPSKPTVNIPSS

SEQ ID NO: 4615 - protein, 5 aa, Artificial Sequence
  source: /note="Description of Artificial Sequence: Synthetic Linker"
FFSIL

SEQ ID NO: 4616 - protein, 6 aa, Artificial Sequence
  source: /note="Description of Artificial Sequence: Synthetic Linker"
TTGEWK

SEQ ID NO: 4617 - protein, 7 aa, Artificial Sequence
  source: /note="Description of Artificial Sequence: Synthetic Linker"
MSTEEAE

SEQ ID NO: 4618 - protein, 8 aa, Artificial Sequence
  source: /note="Description of Artificial Sequence: Synthetic Linker"
ASQVESDW

SEQ ID NO: 4619 - protein, 7 aa, Artificial Sequence
  source: /note="Description of Artificial Sequence: Synthetic Linker"
KLHLSNC

SEQ ID NO: 4620 - protein, 4 aa, Artificial Sequence
  source: /note="Description of Artificial Sequence: Synthetic Linker"
DANF

SEQ ID NO: 4621 - protein, 7 aa, Artificial Sequence
  source: /note="Description of Artificial Sequence: Synthetic Linker"
VGLEKNA

SEQ ID NO: 4622 - protein, 8 aa, Artificial Sequence
  source: /note="Description of Artificial Sequence: Synthetic Linker"
TNSTEETL

SEQ ID NO: 4623 - protein, 9 aa, Artificial Sequence
  source: /note="Description of Artificial Sequence: Synthetic Linker"
KTWENVNAQ

SEQ ID NO: 4624 - protein, 9 aa, Artificial Sequence
  source: /note="Description of Artificial Sequence: Synthetic Linker"
YLPTLYVSQ

SEQ ID NO: 4625 - protein, 11 aa, Artificial Sequence
  source: /note="Description of Artificial Sequence: Synthetic Linker"
SHRYGFGKIDA

SEQ ID NO: 4626 - protein, 12 aa, Artificial Sequence
  source: /note="Description of Artificial Sequence: Synthetic Linker"
GDWRDSAMGKKY

SEQ ID NO: 4627 - protein, 4 aa, Artificial Sequence
  source: /note="Description of Artificial Sequence: Synthetic Linker"
KGTL

SEQ ID NO: 4628 - protein, 7 aa, Artificial Sequence
  source: /note="Description of Artificial Sequence: Synthetic Linker"
KLNKDIV

SEQ ID NO: 4629 - protein, 8 aa, Artificial Sequence
  source: /note="Description of Artificial Sequence: Synthetic Linker"
ETRKRALS

SEQ ID NO: 4630 - protein, 33 aa, Artificial Sequence
  source: /note="Description of Artificial Sequence: Synthetic Linker"
VYPPDYNPEGKVTKRKHDNEGSGSKRPKVEYSE

SEQ ID NO: 4631 - protein, 8 aa, Artificial Sequence
  source: /note="Description of Artificial Sequence: Synthetic Linker"
IERHSIHW

SEQ ID NO: 4632 - protein, 9 aa, Artificial Sequence
  source: /note="Description of Artificial Sequence: Synthetic Linker"
DLTGTPLFV

SEQ ID NO: 4633 - protein, 10 aa, Artificial Sequence
  source: /note="Description of Artificial Sequence: Synthetic Linker"
NGPASLPYDI

SEQ ID NO: 4634 - protein, 14 aa, Artificial Sequence
  source: /note="Description of Artificial Sequence: Synthetic Linker"
VNGSDINVDWGKPI

SEQ ID NO: 4635 - protein, 44 aa, Artificial Sequence
  source: /note="Description of Artificial Sequence: Synthetic Linker"
YAGAPGGLPTDEGTPPVDHQCLDTLDVRPVVPRSVPVNSFVKRP

SEQ ID NO: 4636 - protein, 6 aa, Artificial Sequence
  source: /note="Description of Artificial Sequence: Synthetic Linker"
QFGRKG

SEQ ID NO: 4637 - protein, 9 aa, Artificial Sequence
  source: /note="Description of Artificial Sequence: Synthetic Linker"
IASGAIGGL

SEQ ID NO: 4638 - protein, 4 aa, Artificial Sequence
  source: /note="Description of Artificial Sequence: Synthetic Linker"
SGNP

SEQ ID NO: 4639 - protein, 6 aa, Artificial Sequence
  source: /note="Description of Artificial Sequence: Synthetic Linker"
VTGISP

SEQ ID NO: 4640 - protein, 6 aa, Artificial Sequence
  source: /note="Description of Artificial Sequence: Synthetic Linker"
IKRADA

SEQ ID NO: 4641 - protein, 7 aa, Artificial Sequence
  source: /note="Description of Artificial Sequence: Synthetic Linker"
VQPKLTA

SEQ ID NO: 4642 - protein, 14 aa, Artificial Sequence
  source: /note="Description of Artificial Sequence: Synthetic Linker"
TGVMKNDTNENLKK

SEQ ID NO: 4643 - protein, 24 aa, Artificial Sequence
  source: /note="Description of Artificial Sequence: Synthetic Linker"
FLPRVGVGTSFGLPQTRRISLASP

SEQ ID NO: 4644 - protein, 4 aa, Artificial Sequence
  source: /note="Description of Artificial Sequence: Synthetic Linker"
ASNM

SEQ ID NO: 4645 - protein, 6 aa, Artificial Sequence
  source: /note="Description of Artificial Sequence: Synthetic Linker"
ESKPSV

SEQ ID NO: 4646 - protein, 7 aa, Artificial Sequence
  source: /note="Description of Artificial Sequence: Synthetic Linker"
IKMLGSK

SEQ ID NO: 4647 - protein, 7 aa, Artificial Sequence
  source: /note="Description of Artificial Sequence: Synthetic Linker"
LRREPNL

SEQ ID NO: 4648 - protein, 7 aa, Artificial Sequence
  source: /note="Description of Artificial Sequence: Synthetic Linker"
LSRSSNP

SEQ ID NO: 4649 - protein, 8 aa, Artificial Sequence
  source: /note="Description of Artificial Sequence: Synthetic Linker"
RLGCRYSK

SEQ ID NO: 4650 - protein, 4 aa, Artificial Sequence
  source: /note="Description of Artificial Sequence: Synthetic Linker"
ETPA

SEQ ID NO: 4651 - protein, 8 aa, Artificial Sequence
  source: /note="Description of Artificial Sequence: Synthetic Linker"
FANHTYVP

SEQ ID NO: 4652 - protein, 5 aa, Artificial Sequence
  source: /note="Description of Artificial Sequence: Synthetic Linker"
LFEWL

SEQ ID NO: 4653 - protein, 14 aa, Artificial Sequence
  source: /note="Description of Artificial Sequence: Synthetic Linker"
HELGGKNASGGYGG

SEQ ID NO: 4654 - protein, 5 aa, Artificial Sequence
  source: /note="Description of Artificial Sequence: Synthetic Linker"
RGDVG

SEQ ID NO: 4655 - protein, 4 aa, Artificial Sequence
  source: /note="Description of Artificial Sequence: Synthetic Linker"
DYTR

SEQ ID NO: 4656 - protein, 8 aa, Artificial Sequence
  source: /note="Description of Artificial Sequence: Synthetic Linker"
QTQAVSQQ

SEQ ID NO: 4657 - protein, 8 aa, Artificial Sequence
  source: /note="Description of Artificial Sequence: Synthetic Linker"
YTDHQMLV

SEQ ID NO: 4658 - protein, 4 aa, Artificial Sequence
  source: /note="Description of Artificial Sequence: Synthetic Linker"
LNNR

SEQ ID NO: 4659 - protein, 12 aa, Artificial Sequence
  source: /note="Description of Artificial Sequence: Synthetic Linker"
TCRKTNKLSPYD

SEQ ID NO: 4660 - protein, 5 aa, Artificial Sequence
  source: /note="Description of Artificial Sequence: Synthetic Linker"
VVNNV

SEQ ID NO: 4661 - protein, 7 aa, Artificial Sequence
  source: /note="Description of Artificial Sequence: Synthetic Linker"
VQARASS

SEQ ID NO: 4662 - protein, 8 aa, Artificial Sequence
  source: /note="Description of Artificial Sequence: Synthetic Linker"
TYIPRKEV

SEQ ID NO: 4663 - protein, 10 aa, Artificial Sequence
  source: /note="Description of Artificial Sequence: Synthetic Linker"
IQATIIRQNQ

SEQ ID NO: 4664 - protein, 4 aa, Artificial Sequence
  source: /note="Description of Artificial Sequence: Synthetic Linker"
KGDD

SEQ ID NO: 4665 - protein, 4 aa, Artificial Sequence
  source: /note="Description of Artificial Sequence: Synthetic Linker"
SDVV

SEQ ID NO: 4666 - protein, 6 aa, Artificial Sequence
  source: /note="Description of Artificial Sequence: Synthetic Linker"
VAQSSY

SEQ ID NO: 4667 - protein, 8 aa, Artificial Sequence
  source: /note="Description of Artificial Sequence: Synthetic Linker"
TSRDYDTQ

SEQ ID NO: 4668 - protein, 11 aa, Artificial Sequence
  source: /note="Description of Artificial Sequence: Synthetic Linker"
YAPFLPKTWTS

SEQ ID NO: 4669 - protein, 5 aa, Artificial Sequence
  source: /note="Description of Artificial Sequence: Synthetic Linker"
AGVNL

SEQ ID NO: 4670 - protein, 11 aa, Artificial Sequence
  source: /note="Description of Artificial Sequence: Synthetic Linker"
TLLLKSPTTHP

SEQ ID NO: 4671 - protein, 5 aa, Artificial Sequence
  source: /note="Description of Artificial Sequence: Synthetic Linker"
VESAM

SEQ ID NO: 4672 - protein, 6 aa, Artificial Sequence
  source: /note="Description of Artificial Sequence: Synthetic Linker"
GPLWSN

SEQ ID NO: 4673 - protein, 9 aa, Artificial Sequence
  source: /note="Description of Artificial Sequence: Synthetic Linker"
QVENTGIHE

SEQ ID NO: 4674 - protein, 8 aa, Artificial Sequence
  source: /note="Description of Artificial Sequence: Synthetic Linker"
SCDNLPHN

SEQ ID NO: 4675 - protein, 16 aa, Artificial Sequence
  source: /note="Description of Artificial Sequence: Synthetic Linker"
ICDRNHTWLPVSDDAC

SEQ ID NO: 4676 - protein, 4 aa, Artificial Sequence
  source: /note="Description of Artificial Sequence: Synthetic Linker"
YYPA

SEQ ID NO: 4677 - protein, 5 aa, Artificial Sequence
  source: /note="Description of Artificial Sequence: Synthetic Linker"
SGQPL

SEQ ID NO: 4678 - protein, 5 aa, Artificial Sequence
  source: /note="Description of Artificial Sequence: Synthetic Linker"
VYSGK

SEQ ID NO: 4679 - protein, 7 aa, Artificial Sequence
  source: /note="Description of Artificial Sequence: Synthetic Linker"
VNDQGKE

SEQ ID NO: 4680 - protein, 11 aa, Artificial Sequence
  source: /note="Description of Artificial Sequence: Synthetic Linker"
FGNKYWLMLNE

SEQ ID NO: 4681 - protein, 19 aa, Artificial Sequence
  source: /note="Description of Artificial Sequence: Synthetic Linker"
QSFAPVKGASAVPLVGRAS

SEQ ID NO: 4682 - protein, 4 aa, Artificial Sequence
  source: /note="Description of Artificial Sequence: Synthetic Linker"
PVSE

SEQ ID NO: 4683 - protein, 5 aa, Artificial Sequence
  source: /note="Description of Artificial Sequence: Synthetic Linker"
AGKLV

SEQ ID NO: 4684 - protein, 7 aa, Artificial Sequence
  source: /note="Description of Artificial Sequence: Synthetic Linker"
LEKDGSN

SEQ ID NO: 4685 - protein, 14 aa, Artificial Sequence
  source: /note="Description of Artificial Sequence: Synthetic Linker"
NNDPSWNPGPTWDP

SEQ ID NO: 4686 - protein, 4 aa, Artificial Sequence
  source: /note="Description of Artificial Sequence: Synthetic Linker"
GVPF

SEQ ID NO: 4687 - protein, 4 aa, Artificial Sequence
  source: /note="Description of Artificial Sequence: Synthetic Linker"
ICQS

SEQ ID NO: 4688 - protein, 6 aa, Artificial Sequence
  source: /note="Description of Artificial Sequence: Synthetic Linker"
VNYEDP

SEQ ID NO: 4689 - protein, 8 aa, Artificial Sequence
  source: /note="Description of Artificial Sequence: Synthetic Linker"
RARGENEP

SEQ ID NO: 4690 - protein, 6 aa, Artificial Sequence
  source: /note="Description of Artificial Sequence: Synthetic Linker"
LAGTGP

SEQ ID NO: 4691 - protein, 10 aa, Artificial Sequence
  source: /note="Description of Artificial Sequence: Synthetic Linker"
AAGGSVKGKK

SEQ ID NO: 4692 - protein, 8 aa, Artificial Sequence
  source: /note="Description of Artificial Sequence: Synthetic Linker"
LMTPEYVA

SEQ ID NO: 4693 - protein, 17 aa, Artificial Sequence
  source: /note="Description of Artificial Sequence: Synthetic Linker"
GFESVLEAVTALAFYVP

SEQ ID NO: 4694 - protein, 18 aa, Artificial Sequence
  source: /note="Description of Artificial Sequence: Synthetic Linker"
HKLGAVDVPDLVYSEAGP

SEQ ID NO: 4695 - protein, 35 aa, Artificial Sequence
  source: /note="Description of Artificial Sequence: Synthetic Linker"
QHPPKDSSGQRVAVSPTSQRLQLLEPFDKWDGKDL

SEQ ID NO: 4696 - protein, 41 aa, Artificial Sequence
  source: /note="Description of Artificial Sequence: Synthetic Linker"
TLKFNPETDFLTGKDGKKFKLEAPDADELPRAEFDPGQDTY

SEQ ID NO: 4697 - protein, 4 aa, Artificial Sequence
  source: /note="Description of Artificial Sequence: Synthetic Linker"
LVLE

SEQ ID NO: 4698 - protein, 4 aa, Artificial Sequence
  source: /note="Description of Artificial Sequence: Synthetic Linker"
SESG

SEQ ID NO: 4699 - protein, 5 aa, Artificial Sequence
  source: /note="Description of Artificial Sequence: Synthetic Linker"
EISGM

SEQ ID NO: 4700 - protein, 5 aa, Artificial Sequence
  source: /note="Description of Artificial Sequence: Synthetic Linker"
FAARS

SEQ ID NO: 4701 - protein, 7 aa, Artificial Sequence
  source: /note="Description of Artificial Sequence: Synthetic Linker"
QKSGKGL

SEQ ID NO: 4702 - protein, 11 aa, Artificial Sequence
  source: /note="Description of Artificial Sequence: Synthetic Linker"
GEVFPQKKVSA

SEQ ID NO: 4703 - protein, 13 aa, Artificial Sequence
  source: /note="Description of Artificial Sequence: Synthetic Linker"
KHPAVRKEPGPGL

SEQ ID NO: 4704 - protein, 14 aa, Artificial Sequence
  source: /note="Description of Artificial Sequence: Synthetic Linker"
YPHWEGEIIRFETE

SEQ ID NO: 4705 - protein, 9 aa, Artificial Sequence
  source: /note="Description of Artificial Sequence: Synthetic Linker"
EYPALGEVF

SEQ ID NO: 4706 - protein, 7 aa, Artificial Sequence
  source: /note="Description of Artificial Sequence: Synthetic Linker"
QDDDCTP

SEQ ID NO: 4707 - protein, 4 aa, Artificial Sequence
  source: /note="Description of Artificial Sequence: Synthetic Linker"
HNGK

SEQ ID NO: 4708 - protein, 5 aa, Artificial Sequence
  source: /note="Description of Artificial Sequence: Synthetic Linker"
SSVSR

SEQ ID NO: 4709 - protein, 6 aa, Artificial Sequence
  source: /note="Description of Artificial Sequence: Synthetic Linker"
AAHPVG

SEQ ID NO: 4710 - protein, 6 aa, Artificial Sequence
  source: /note="Description of Artificial Sequence: Synthetic Linker"
ARFDVT

SEQ ID NO: 4711 - protein, 6 aa, Artificial Sequence
  source: /note="Description of Artificial Sequence: Synthetic Linker"
EGRDMN

SEQ ID NO: 4712 - protein, 6 aa, Artificial Sequence
  source: /note="Description of Artificial Sequence: Synthetic Linker"
KFLRTE

SEQ ID NO: 4713 - protein, 8 aa, Artificial Sequence
  source: /note="Description of Artificial Sequence: Synthetic Linker"
LDLFYNTP

SEQ ID NO: 4714 - protein, 8 aa, Artificial Sequence
  source: /note="Description of Artificial Sequence: Synthetic Linker"
RTAEQQEA

SEQ ID NO: 4715 - protein, 11 aa, Artificial Sequence
  source: /note="Description of Artificial Sequence: Synthetic Linker"
YRAVPEGGQKE

SEQ ID NO: 4716 - protein, 8 aa, Artificial Sequence
  source: /note="Description of Artificial Sequence: Synthetic Linker"
HDPRRFGR

SEQ ID NO: 4717 - protein, 10 aa, Artificial Sequence
  source: /note="Description of Artificial Sequence: Synthetic Linker"
RRGDYREIPL

SEQ ID NO: 4718 - protein, 11 aa, Artificial Sequence
  source: /note="Description of Artificial Sequence: Synthetic Linker"
RHAVYGREGLP

SEQ ID NO: 4719 - protein, 23 aa, Artificial Sequence
  source: /note="Description of Artificial Sequence: Synthetic Linker"
ELGGSTLSDQSYRQPDGLPGGFQ

SEQ ID NO: 4720 - protein, 6 aa, Artificial Sequence
  source: /note="Description of Artificial Sequence: Synthetic Linker"
ESGKTS

SEQ ID NO: 4721 - protein, 7 aa, Artificial Sequence
  source: /note="Description of Artificial Sequence: Synthetic Linker"
FLDIHNI

SEQ ID NO: 4722 - protein, 7 aa, Artificial Sequence
  source: /note="Description of Artificial Sequence: Synthetic Linker"
VYPNIEE

SEQ ID NO: 4723 - protein, 9 aa, Artificial Sequence
  source: /note="Description of Artificial Sequence: Synthetic Linker"
RQGIPNESW

SEQ ID NO: 4724 - protein, 17 aa, Artificial Sequence
  source: /note="Description of Artificial Sequence: Synthetic Linker"
TKINERYELCDTYPALL

SEQ ID NO: 4725 - protein, 4 aa, Artificial Sequence
  source: /note="Description of Artificial Sequence: Synthetic Linker"
NGIV

SEQ ID NO: 4726 - protein, 5 aa, Artificial Sequence
  source: /note="Description of Artificial Sequence: Synthetic Linker"
SRRVP

SEQ ID NO: 4727 - protein, 17 aa, Artificial Sequence
  source: /note="Description of Artificial Sequence: Synthetic Linker"
LEKEKQFEKYSELKGTV

SEQ ID NO: 4728 - protein, 12 aa, Artificial Sequence
  source: /note="Description of Artificial Sequence: Synthetic Linker"
KDSPKGVGRPTK

SEQ ID NO: 4729 - protein, 4 aa, Artificial Sequence
  source: /note="Description of Artificial Sequence: Synthetic Linker"
ILIP

SEQ ID NO: 4730 - protein, 4 aa, Artificial Sequence
  source: /note="Description of Artificial Sequence: Synthetic Linker"
LAPA

SEQ ID NO: 4731 - protein, 5 aa, Artificial Sequence
  source: /note="Description of Artificial Sequence: Synthetic Linker"
CSGEY

SEQ ID NO: 4732 - protein, 5 aa, Artificial Sequence
  source: /note="Description of Artificial Sequence: Synthetic Linker"
STPHP

SEQ ID NO: 4733 - protein, 5 aa, Artificial Sequence
  source: /note="Description of Artificial Sequence: Synthetic Linker"
WGCDK

SEQ ID NO: 4734 - protein, 6 aa, Artificial Sequence
  source: /note="Description of Artificial Sequence: Synthetic Linker"
YFAMDE

SEQ ID NO: 4735 - protein, 9 aa, Artificial Sequence
  source: /note="Description of Artificial Sequence: Synthetic Linker"
RAETIDDIR

SEQ ID NO: 4736 - protein, 6 aa, Artificial Sequence
  source: /note="Description of Artificial Sequence: Synthetic Linker"
NDDIQG

SEQ ID NO: 4737 - protein, 7 aa, Artificial Sequence
  source: /note="Description of Artificial Sequence: Synthetic Linker"
YREKYCT

SEQ ID NO: 4738 - protein, 4 aa, Artificial Sequence
  source: /note="Description of Artificial Sequence: Synthetic Linker"
DADL

SEQ ID NO: 4739 - protein, 4 aa, Artificial Sequence
  source: /note="Description of Artificial Sequence: Synthetic Linker"
PNTA

SEQ ID NO: 4740 - protein, 5 aa, Artificial Sequence
  source: /note="Description of Artificial Sequence: Synthetic Linker"
VAVGV

SEQ ID NO: 4741 - protein, 6 aa, Artificial Sequence
  source: /note="Description of Artificial Sequence: Synthetic Linker"
VNIALA

SEQ ID NO: 4742 - protein, 17 aa, Artificial Sequence
  source: /note="Description of Artificial Sequence: Synthetic Linker"
KNLEEPVKPFPGVQGSS

SEQ ID NO: 4743 - protein, 26 aa, Artificial Sequence
  source: /note="Description of Artificial Sequence: Synthetic Linker"
LKGTLELHPNGLIKTDEYMRTSEPDV

SEQ ID NO: 4744 - protein, 6 aa, Artificial Sequence
  source: /note="Description of Artificial Sequence: Synthetic Linker"
YYPQIA

SEQ ID NO: 4745 - protein, 4 aa, Artificial Sequence
  source: /note="Description of Artificial Sequence: Synthetic Linker"
LGDA

SEQ ID NO: 4746 - protein, 7 aa, Artificial Sequence
  source: /note="Description of Artificial Sequence: Synthetic Linker"
FKHSGGL

SEQ ID NO: 4747 - protein, 20 aa, Artificial Sequence
  source: /note="Description of Artificial Sequence: Synthetic Linker"
FEAERKENCPACSQLPQNIQ

SEQ ID NO: 4748 - protein, 8 aa, Artificial Sequence
  source: /note="Description of Artificial Sequence: Synthetic Linker"
YGLDTINK

SEQ ID NO: 4749 - protein, 9 aa, Artificial Sequence
  source: /note="Description of Artificial Sequence: Synthetic Linker"
SMDNPDNEI

SEQ ID NO: 4750 - protein, 10 aa, Artificial Sequence
  source: /note="Description of Artificial Sequence: Synthetic Linker"
QQGRYPGVSN

SEQ ID NO: 4751 - protein, 8 aa, Artificial Sequence
  source: /note="Description of Artificial Sequence: Synthetic Linker"
TKLQNPDL

SEQ ID NO: 4752 - protein, 10 aa, Artificial Sequence
  source: /note="Description of Artificial Sequence: Synthetic Linker"
GGRGYGSESG

SEQ ID NO: 4753 - protein, 12 aa, Artificial Sequence
  source: /note="Description of Artificial Sequence: Synthetic Linker"
LQQHRPSPELTL

SEQ ID NO: 4754 - protein, 17 aa, Artificial Sequence
  source: /note="Description of Artificial Sequence: Synthetic Linker"
LGGKWQPGRGPCVLQEY

SEQ ID NO: 4755 - protein, 5 aa, Artificial Sequence
  source: /note="Description of Artificial Sequence: Synthetic Linker"
YQKLT

SEQ ID NO: 4756 - protein, 7 aa, Artificial Sequence
  source: /note="Description of Artificial Sequence: Synthetic Linker"
FISNQTI

SEQ ID NO: 4757 - protein, 7 aa, Artificial Sequence
  source: /note="Description of Artificial Sequence: Synthetic Linker"
SWEGNPI

SEQ ID NO: 4758 - protein, 8 aa, Artificial Sequence
  source: /note="Description of Artificial Sequence: Synthetic Linker"
FREVVSPQ

SEQ ID NO: 4759 - protein, 9 aa, Artificial Sequence
  source: /note="Description of Artificial Sequence: Synthetic Linker"
LADVPSSPY

SEQ ID NO: 4760 - protein, 4 aa, Artificial Sequence
  source: /note="Description of Artificial Sequence: Synthetic Linker"
FVSA

SEQ ID NO: 4761 - protein, 4 aa, Artificial Sequence
  source: /note="Description of Artificial Sequence: Synthetic Linker"
HKRS

SEQ ID NO: 4762 - protein, 5 aa, Artificial Sequence
  source: /note="Description of Artificial Sequence: Synthetic Linker"
KAAPD

SEQ ID NO: 4763 - protein, 19 aa, Artificial Sequence
  source: /note="Description of Artificial Sequence: Synthetic Linker"
PLDSPDETEDPEPNYAGEP

SEQ ID NO: 4764 - protein, 6 aa, Artificial Sequence
  source: /note="Description of Artificial Sequence: Synthetic Linker"
EVGNEE

SEQ ID NO: 4765 - protein, 13 aa, Artificial Sequence
  source: /note="Description of Artificial Sequence: Synthetic Linker"
ALPDEETGLELNE

SEQ ID NO: 4766 - protein, 4 aa, Artificial Sequence
  source: /note="Description of Artificial Sequence: Synthetic Linker"
QVDA

SEQ ID NO: 4767 - protein, 5 aa, Artificial Sequence
  source: /note="Description of Artificial Sequence: Synthetic Linker"
WRKDP

SEQ ID NO: 4768 - protein, 6 aa, Artificial Sequence
  source: /note="Description of Artificial Sequence: Synthetic Linker"
PSHGII

SEQ ID NO: 4769 - protein, 7 aa, Artificial Sequence
  source: /note="Description of Artificial Sequence: Synthetic Linker"
EGQGKAK

SEQ ID NO: 4770 - protein, 8 aa, Artificial Sequence
  source: /note="Description of Artificial Sequence: Synthetic Linker"
KINLAIKT

SEQ ID NO: 4771 - protein, 8 aa, Artificial Sequence
  source: /note="Description of Artificial Sequence: Synthetic Linker"
TEMYDTPT

SEQ ID NO: 4772 - protein, 6 aa, Artificial Sequence
  source: /note="Description of Artificial Sequence: Synthetic Linker"
AHELPM

SEQ ID NO: 4773 - protein, 12 aa, Artificial Sequence
  source: /note="Description of Artificial Sequence: Synthetic Linker"
EKPKGRDSKKVR

SEQ ID NO: 4774 - protein, 14 aa, Artificial Sequence
  source: /note="Description of Artificial Sequence: Synthetic Linker"
IEGTSPEIVVNPVR

SEQ ID NO: 4775 - protein, 7 aa, Artificial Sequence
  source: /note="Description of Artificial Sequence: Synthetic Linker"
QRTKVQI

SEQ ID NO: 4776 - protein, 26 aa, Artificial Sequence
  source: /note="Description of Artificial Sequence: Synthetic Linker"
VDMGFDTSKLGSYQRVAEPVVPPQEM

SEQ ID NO: 4777 - protein, 5 aa, Artificial Sequence
  source: /note="Description of Artificial Sequence: Synthetic Linker"
MNAHI

SEQ ID NO: 4778 - protein, 6 aa, Artificial Sequence
  source: /note="Description of Artificial Sequence: Synthetic Linker"
ADDYQA

SEQ ID NO: 4779 - protein, 6 aa, Artificial Sequence
  source: /note="Description of Artificial Sequence: Synthetic Linker"
YEGFTG

SEQ ID NO: 4780 - protein, 7 aa, Artificial Sequence
  source: /note="Description of Artificial Sequence: Synthetic Linker"
QVDDPLK

SEQ ID NO: 4781 - protein, 11 aa, Artificial Sequence
  source: /note="Description of Artificial Sequence: Synthetic Linker"
YKPKRFEYVTW

SEQ ID NO: 4782 - protein, 13 aa, Artificial Sequence
  source: /note="Description of Artificial Sequence: Synthetic Linker"
ILPLWHHDDTYLF

SEQ ID NO: 4783 - protein, 22 aa, Artificial Sequence
  source: /note="Description of Artificial Sequence: Synthetic Linker"
DMILPKKSVSKVKQTQLLTTEG

SEQ ID NO: 4784 - protein, 4 aa, Artificial Sequence
  source: /note="Description of Artificial Sequence: Synthetic Linker"
IDNP

SEQ ID NO: 4785 - protein, 4 aa, Artificial Sequence
  source: /note="Description of Artificial Sequence: Synthetic Linker"
GMDH

SEQ ID NO: 4786 - protein, 4 aa, Artificial Sequence
  source: /note="Description of Artificial Sequence: Synthetic Linker"
IGDC

SEQ ID NO: 4787 - protein, 5 aa, Artificial Sequence
  source: /note="Description of Artificial Sequence: Synthetic Linker"
EGVLH

SEQ ID NO: 4788 - protein, 5 aa, Artificial Sequence
  source: /note="Description of Artificial Sequence: Synthetic Linker"
NQKEL

SEQ ID NO: 4789 - protein, 5 aa, Artificial Sequence
  source: /note="Description of Artificial Sequence: Synthetic Linker"
QGNAL

SEQ ID NO: 4790 - protein, 5 aa, Artificial Sequence
  source: /note="Description of Artificial Sequence: Synthetic Linker"
QSGYQ

SEQ ID NO: 4791 - protein, 6 aa, Artificial Sequence
  source: /note="Description of Artificial Sequence: Synthetic Linker"
ARPDDE

SEQ ID NO: 4792 - protein, 6 aa, Artificial Sequence
  source: /note="Description of Artificial Sequence: Synthetic Linker"
MGVSAI

SEQ ID NO: 4793 - protein, 6 aa, Artificial Sequence
  source: /note="Description of Artificial Sequence: Synthetic Linker"
RNFQGY

SEQ ID NO: 4794 - protein, 7 aa, Artificial Sequence
  source: /note="Description of Artificial Sequence: Synthetic Linker"
TTQGDTD

SEQ ID NO: 4795 - protein, 5 aa, Artificial Sequence
  source: /note="Description of Artificial Sequence: Synthetic Linker"
IRDAN

SEQ ID NO: 4796 - protein, 7 aa, Artificial Sequence
  source: /note="Description of Artificial Sequence: Synthetic Linker"
YARPSSA

SEQ ID NO: 4797 - protein, 4 aa, Artificial Sequence
  source: /note="Description of Artificial Sequence: Synthetic Linker"
RGKF

SEQ ID NO: 4798 - protein, 4 aa, Artificial Sequence
  source: /note="Description of Artificial Sequence: Synthetic Linker"
THAV

SEQ ID NO: 4799 - protein, 5 aa, Artificial Sequence
  source: /note="Description of Artificial Sequence: Synthetic Linker"
ETPKI

SEQ ID NO: 4800 - protein, 5 aa, Artificial Sequence
  source: /note="Description of Artificial Sequence: Synthetic Linker"
SDTAN

SEQ ID NO: 4801 - protein, 7 aa, Artificial Sequence
  source: /note="Description of Artificial Sequence: Synthetic Linker"
TKQLAPT

SEQ ID NO: 4802 - protein, 10 aa, Artificial Sequence
  source: /note="Description of Artificial Sequence: Synthetic Linker"
AGDYKNLGGE

SEQ ID NO: 4803 - protein, 19 aa, Artificial Sequence
  source: /note="Description of Artificial Sequence: Synthetic Linker"
TYYTFNFSLEGAKMSLPGT

SEQ ID NO: 4804 - protein, 5 aa, Artificial Sequence
  source: /note="Description of Artificial Sequence: Synthetic Linker"
YNKSS

SEQ ID NO: 4805 - protein, 8 aa, Artificial Sequence
  source: /note="Description of Artificial Sequence: Synthetic Linker"
YGTPDYKY

SEQ ID NO: 4806 - protein, 11 aa, Artificial Sequence
  source: /note="Description of Artificial Sequence: Synthetic Linker"
PYGKAHTLGLK

SEQ ID NO: 4807 - protein, 6 aa, Artificial Sequence
  source: /note="Description of Artificial Sequence: Synthetic Linker"
DTEEKK

SEQ ID NO: 4808 - protein, 19 aa, Artificial Sequence
  source: /note="Description of Artificial Sequence: Synthetic Linker"
DIPNRRRKVSKHKHANFYP

SEQ ID NO: 4809 - protein, 6 aa, Artificial Sequence
  source: /note="Description of Artificial Sequence: Synthetic Linker"
PCSHVV

SEQ ID NO: 4810 - protein, 6 aa, Artificial Sequence
  source: /note="Description of Artificial Sequence: Synthetic Linker"
ANENGT

SEQ ID NO: 4811 - protein, 6 aa, Artificial Sequence
  source: /note="Description of Artificial Sequence: Synthetic Linker"
NRKNNI

SEQ ID NO: 4812 - protein, 8 aa, Artificial Sequence
  source: /note="Description of Artificial Sequence: Synthetic Linker"
LAPEDYTG

SEQ ID NO: 4813 - protein, 4 aa, Artificial Sequence
  source: /note="Description of Artificial Sequence: Synthetic Linker"
IGGK

SEQ ID NO: 4814 - protein, 4 aa, Artificial Sequence
  source: /note="Description of Artificial Sequence: Synthetic Linker"
VGDD

SEQ ID NO: 4815 - protein, 6 aa, Artificial Sequence
  source: /note="Description of Artificial Sequence: Synthetic Linker"
INTTKY

SEQ ID NO: 4816 - protein, 7 aa, Artificial Sequence
  source: /note="Description of Artificial Sequence: Synthetic Linker"
AATVTGY

SEQ ID NO: 4817 - protein, 7 aa, Artificial Sequence
  source: /note="Description of Artificial Sequence: Synthetic Linker"
GGADGKT

SEQ ID NO: 4818 - protein, 7 aa, Artificial Sequence
  source: /note="Description of Artificial Sequence: Synthetic Linker"
QNKDGSI

SEQ ID NO: 4819 - protein, 7 aa, Artificial Sequence
  source: /note="Description of Artificial Sequence: Synthetic Linker"
TDNNGKT

SEQ ID NO: 4820 - protein, 8 aa, Artificial Sequence
  source: /note="Description of Artificial Sequence: Synthetic Linker"
AAGVTGTA

SEQ ID NO: 4821 - protein, 9 aa, Artificial Sequence
  source: /note="Description of Artificial Sequence: Synthetic Linker"
QVGANDGET

SEQ ID NO: 4822 - protein, 11 aa, Artificial Sequence
  source: /note="Description of Artificial Sequence: Synthetic Linker"
TADDGTSKTAL

SEQ ID NO: 4823 - protein, 21 aa, Artificial Sequence
  source: /note="Description of Artificial Sequence: Synthetic Linker"
LKQINSQTLGLDTLNVQQKYK

SEQ ID NO: 4824 - protein, 23 aa, Artificial Sequence
  source: /note="Description of Artificial Sequence: Synthetic Linker"
AEGHNFKAQPDLAEAAATTTENP

SEQ ID NO: 4825 - protein, 4 aa, Artificial Sequence
  source: /note="Description of Artificial Sequence: Synthetic Linker"
AGAR

SEQ ID NO: 4826 - protein, 5 aa, Artificial Sequence
  source: /note="Description of Artificial Sequence: Synthetic Linker"
AEALL

SEQ ID NO: 4827 - protein, 6 aa, Artificial Sequence
  source: /note="Description of Artificial Sequence: Synthetic Linker"
AWPEEV

SEQ ID NO: 4828 - protein, 6 aa, Artificial Sequence
  source: /note="Description of Artificial Sequence: Synthetic Linker"
NRGVEA

SEQ ID NO: 4829 - protein, 8 aa, Artificial Sequence
  source: /note="Description of Artificial Sequence: Synthetic Linker"
EALPLPFA

SEQ ID NO: 4830 - protein, 8 aa, Artificial Sequence
  source: /note="Description of Artificial Sequence: Synthetic Linker"
RGVDPLGQ

SEQ ID NO: 4831 - protein, 9 aa, Artificial Sequence
  source: /note="Description of Artificial Sequence: Synthetic Linker"
LEVTPNRPD

SEQ ID NO: 4832 - protein, 9 aa, Artificial Sequence
  source: /note="Description of Artificial Sequence: Synthetic Linker"
VEDPEGAPH

SEQ ID NO: 4833 - protein, 10 aa, Artificial Sequence
  source: /note="Description of Artificial Sequence: Synthetic Linker"
AGSPKPPEAI

SEQ ID NO: 4834 - protein, 10 aa, Artificial Sequence
  source: /note="Description of Artificial Sequence: Synthetic Linker"
FGLRVAPSPL

SEQ ID NO: 4835 - protein, 13 aa, Artificial Sequence
  source: /note="Description of Artificial Sequence: Synthetic Linker"
TIPLALPAFFPAP

SEQ ID NO: 4836 - protein, 14 aa, Artificial Sequence
  source: /note="Description of Artificial Sequence: Synthetic Linker"
LGYALVEPEAALKA

SEQ ID NO: 4837 - protein, 19 aa, Artificial Sequence
  source: /note="Description of Artificial Sequence: Synthetic Linker"
LPLPDKPLAFQDPSRHPAA

SEQ ID NO: 4838 - protein, 5 aa, Artificial Sequence
  source: /note="Description of Artificial Sequence: Synthetic Linker"
GLQSA

SEQ ID NO: 4839 - protein, 6 aa, Artificial Sequence
  source: /note="Description of Artificial Sequence: Synthetic Linker"
HGELTR

SEQ ID NO: 4840 - protein, 7 aa, Artificial Sequence
  source: /note="Description of Artificial Sequence: Synthetic Linker"
LKDKQLN

SEQ ID NO: 4841 - protein, 5 aa, Artificial Sequence
  source: /note="Description of Artificial Sequence: Synthetic Linker"
FYPQY

SEQ ID NO: 4842 - protein, 7 aa, Artificial Sequence
  source: /note="Description of Artificial Sequence: Synthetic Linker"
DFHYDEK

SEQ ID NO: 4843 - protein, 10 aa, Artificial Sequence
  source: /note="Description of Artificial Sequence: Synthetic Linker"
DYLLDFSAVY

SEQ ID NO: 4844 - protein, 10 aa, Artificial Sequence
  source: /note="Description of Artificial Sequence: Synthetic Linker"
PLDVTNRPRT

SEQ ID NO: 4845 - protein, 17 aa, Artificial Sequence
  source: /note="Description of Artificial Sequence: Synthetic Linker"
NGEYSLKSAVKLPNVLS

SEQ ID NO: 4846 - protein, 6 aa, Artificial Sequence
  source: /note="Description of Artificial Sequence: Synthetic Linker"
DRRAGL

SEQ ID NO: 4847 - protein, 7 aa, Artificial Sequence
  source: /note="Description of Artificial Sequence: Synthetic Linker"
FLASMDE

SEQ ID NO: 4848 - protein, 8 aa, Artificial Sequence
  source: /note="Description of Artificial Sequence: Synthetic Linker"
IMRETINV

SEQ ID NO: 4849 - protein, 11 aa, Artificial Sequence
  source: /note="Description of Artificial Sequence: Synthetic Linker"
RFPNARTSYTM

SEQ ID NO: 4850 - protein, 6 aa, Artificial Sequence
  source: /note="Description of Artificial Sequence: Synthetic Linker"
SDPAKV

SEQ ID NO: 4851 - protein, 11 aa, Artificial Sequence
  source: /note="Description of Artificial Sequence: Synthetic Linker"
TSNGASCMPSM

SEQ ID NO: 4852 - protein, 12 aa, Artificial Sequence
  source: /note="Description of Artificial Sequence: Synthetic Linker"
AGSAPAEPTGDV

SEQ ID NO: 4853 - protein, 7 aa, Artificial Sequence
  source: /note="Description of Artificial Sequence: Synthetic Linker"
MRVKNDF

SEQ ID NO: 4854 - protein, 14 aa, Artificial Sequence
  source: /note="Description of Artificial Sequence: Synthetic Linker"
YEGKDVHIKEDERY

SEQ ID NO: 4855 - protein, 15 aa, Artificial Sequence
  source: /note="Description of Artificial Sequence: Synthetic Linker"
LGLKIIDLSAIQDEV

SEQ ID NO: 4856 - protein, 5 aa, Artificial Sequence
  source: /note="Description of Artificial Sequence: Synthetic Linker"
LEPSR

SEQ ID NO: 4857 - protein, 6 aa, Artificial Sequence
  source: /note="Description of Artificial Sequence: Synthetic Linker"
CSNVAA

SEQ ID NO: 4858 - protein, 8 aa, Artificial Sequence
  source: /note="Description of Artificial Sequence: Synthetic Linker"
QKVTINPV

SEQ ID NO: 4859 - protein, 11 aa, Artificial Sequence
  source: /note="Description of Artificial Sequence: Synthetic Linker"
ALPPGAAKQQL

SEQ ID NO: 4860 - protein, 11 aa, Artificial Sequence
  source: /note="Description of Artificial Sequence: Synthetic Linker"
ALRRGTAGSVT

SEQ ID NO: 4861 - protein, 16 aa, Artificial Sequence
  source: /note="Description of Artificial Sequence: Synthetic Linker"
ESFGATNTNARENTPF

SEQ ID NO: 4862 - protein, 4 aa, Artificial Sequence
  source: /note="Description of Artificial Sequence: Synthetic Linker"
DCDY

SEQ ID NO: 4863 - protein, 4 aa, Artificial Sequence
  source: /note="Description of Artificial Sequence: Synthetic Linker"
DWSD

SEQ ID NO: 4864 - protein, 4 aa, Artificial Sequence
  source: /note="Description of Artificial Sequence: Synthetic Linker"
FAGQ

SEQ ID NO: 4865 - protein, 4 aa, Artificial Sequence
  source: /note="Description of Artificial Sequence: Synthetic Linker"
HEGV

SEQ ID NO: 4866 - protein, 4 aa, Artificial Sequence
  source: /note="Description of Artificial Sequence: Synthetic Linker"
RDGE

SEQ ID NO: 4867 - protein, 4 aa, Artificial Sequence
  source: /note="Description of Artificial Sequence: Synthetic Linker"
SATR

SEQ ID NO: 4868 - protein, 4 aa, Artificial Sequence
  source: /note="Description of Artificial Sequence: Synthetic Linker"
SIPA

SEQ ID NO: 4869 - protein, 4 aa, Artificial Sequence
  source: /note="Description of Artificial Sequence: Synthetic Linker"
VYGQ

SEQ ID NO: 4870 - protein, 5 aa, Artificial Sequence
  source: /note="Description of Artificial Sequence: Synthetic Linker"
ACGAT

SEQ ID NO: 4871 - protein, 5 aa, Artificial Sequence
  source: /note="Description of Artificial Sequence: Synthetic Linker"
VYQAA

SEQ ID NO: 4872 - protein, 6 aa, Artificial Sequence
  source: /note="Description of Artificial Sequence: Synthetic Linker"
EAGVDR

SEQ ID NO: 4873 - protein, 6 aa, Artificial Sequence
  source: /note="Description of Artificial Sequence: Synthetic Linker"
SGGKTV

SEQ ID NO: 4874 - protein, 7 aa, Artificial Sequence
  source: /note="Description of Artificial Sequence: Synthetic Linker"
VPLSEKV

SEQ ID NO: 4875 - protein, 8 aa, Artificial Sequence
  source: /note="Description of Artificial Sequence: Synthetic Linker"
ANHPRGFA

SEQ ID NO: 4876 - protein, 9 aa, Artificial Sequence
  source: /note="Description of Artificial Sequence: Synthetic Linker"
HDLQGERPY

SEQ ID NO: 4877 - protein, 10 aa, Artificial Sequence
  source: /note="Description of Artificial Sequence: Synthetic Linker"
GCDGFHGISR

SEQ ID NO: 4878 - protein, 11 aa, Artificial Sequence
  source: /note="Description of Artificial Sequence: Synthetic Linker"
ADTPPVSHELI

SEQ ID NO: 4879 - protein, 4 aa, Artificial Sequence
  source: /note="Description of Artificial Sequence: Synthetic Linker"
GHRQ

SEQ ID NO: 4880 - protein, 4 aa, Artificial Sequence
  source: /note="Description of Artificial Sequence: Synthetic Linker"
LTGA

SEQ ID NO: 4881 - protein, 6 aa, Artificial Sequence
  source: /note="Description of Artificial Sequence: Synthetic Linker"
ALPSEL

SEQ ID NO: 4882 - protein, 6 aa, Artificial Sequence
  source: /note="Description of Artificial Sequence: Synthetic Linker"
RAGGSI

SEQ ID NO: 4883 - protein, 6 aa, Artificial Sequence
  source: /note="Description of Artificial Sequence: Synthetic Linker"
VSADNV

SEQ ID NO: 4884 - protein, 11 aa, Artificial Sequence
  source: /note="Description of Artificial Sequence: Synthetic Linker"
HTQTDTSSPDP

SEQ ID NO: 4885 - protein, 12 aa, Artificial Sequence
  source: /note="Description of Artificial Sequence: Synthetic Linker"
LKREKQDESCSL

SEQ ID NO: 4886 - protein, 13 aa, Artificial Sequence
  source: /note="Description of Artificial Sequence: Synthetic Linker"
FNPLKTGVCQLDN

SEQ ID NO: 4887 - protein, 4 aa, Artificial Sequence
  source: /note="Description of Artificial Sequence: Synthetic Linker"
ALGI

SEQ ID NO: 4888 - protein, 4 aa, Artificial Sequence
  source: /note="Description of Artificial Sequence: Synthetic Linker"
NLRS

SEQ ID NO: 4889 - protein, 6 aa, Artificial Sequence
  source: /note="Description of Artificial Sequence: Synthetic Linker"
EIPKPS

SEQ ID NO: 4890 - protein, 7 aa, Artificial Sequence
  source: /note="Description of Artificial Sequence: Synthetic Linker"
EKMVEPQ

SEQ ID NO: 4891 - protein, 10 aa, Artificial Sequence
  source: /note="Description of Artificial Sequence: Synthetic Linker"
KSKVYTRTPT

SEQ ID NO: 4892 - protein, 6 aa, Artificial Sequence
  source: /note="Description of Artificial Sequence: Synthetic Linker"
ELVPKP

SEQ ID NO: 4893 - protein, 6 aa, Artificial Sequence
  source: /note="Description of Artificial Sequence: Synthetic Linker"
FGFPGG

SEQ ID NO: 4894 - protein, 6 aa, Artificial Sequence
  source: /note="Description of Artificial Sequence: Synthetic Linker"
LRNLDE

SEQ ID NO: 4895 - protein, 7 aa, Artificial Sequence
  source: /note="Description of Artificial Sequence: Synthetic Linker"
FSNKKSW

SEQ ID NO: 4896 - protein, 7 aa, Artificial Sequence
  source: /note="Description of Artificial Sequence: Synthetic Linker"
LFEKNDF

SEQ ID NO: 4897 - protein, 7 aa, Artificial Sequence
  source: /note="Description of Artificial Sequence: Synthetic Linker"
LYPNACS

SEQ ID NO: 4898 - protein, 7 aa, Artificial Sequence
  source: /note="Description of Artificial Sequence: Synthetic Linker"
RRAVYAN

SEQ ID NO: 4899 - protein, 7 aa, Artificial Sequence
  source: /note="Description of Artificial Sequence: Synthetic Linker"
RSHRMPV

SEQ ID NO: 4900 - protein, 8 aa, Artificial Sequence
  source: /note="Description of Artificial Sequence: Synthetic Linker"
EWNWPQPV

SEQ ID NO: 4901 - protein, 16 aa, Artificial Sequence
  source: /note="Description of Artificial Sequence: Synthetic Linker"
ITPAYPSMCATHNITE

SEQ ID NO: 4902 - protein, 16 aa, Artificial Sequence
  source: /note="Description of Artificial Sequence: Synthetic Linker"
RLDQPQVPLSLTLSDK

SEQ ID NO: 4903 - protein, 21 aa, Artificial Sequence
  source: /note="Description of Artificial Sequence: Synthetic Linker"
ILKPIEDGPLQVRVWNPKIYA

SEQ ID NO: 4904 - protein, 16 aa, Artificial Sequence
  source: /note="Description of Artificial Sequence: Synthetic Linker"
ISSSMTNSTAASRPPV

SEQ ID NO: 4905 - protein, 5 aa, Artificial Sequence
  source: /note="Description of Artificial Sequence: Synthetic Linker"
ELVTV

SEQ ID NO: 4906 - protein, 11 aa, Artificial Sequence
  source: /note="Description of Artificial Sequence: Synthetic Linker"
HDDLWQTLPDP

SEQ ID NO: 4907 - protein, 4 aa, Artificial Sequence
  source: /note="Description of Artificial Sequence: Synthetic Linker"
QGTN

SEQ ID NO: 4908 - protein, 16 aa, Artificial Sequence
  source: /note="Description of Artificial Sequence: Synthetic Linker"
NVYPELRVPDHQDIAF

SEQ ID NO: 4909 - protein, 6 aa, Artificial Sequence
  source: /note="Description of Artificial Sequence: Synthetic Linker"
QLSVNQ

SEQ ID NO: 4910 - protein, 8 aa, Artificial Sequence
  source: /note="Description of Artificial Sequence: Synthetic Linker"
DKAQFRNG

SEQ ID NO: 4911 - protein, 13 aa, Artificial Sequence
  source: /note="Description of Artificial Sequence: Synthetic Linker"
ENPYRPVTFDYLM

SEQ ID NO: 4912 - protein, 27 aa, Artificial Sequence
  source: /note="Description of Artificial Sequence: Synthetic Linker"
DYGNSPLHRFKKPGSKNFQNIFPPSAT

SEQ ID NO: 4913 - protein, 10 aa, Artificial Sequence
  source: /note="Description of Artificial Sequence: Synthetic Linker"
FKPLPAQESE

SEQ ID NO: 4914 - protein, 7 aa, Artificial Sequence
  source: /note="Description of Artificial Sequence: Synthetic Linker"
KAAGLEM

SEQ ID NO: 4915 - protein, 8 aa, Artificial Sequence
  source: /note="Description of Artificial Sequence: Synthetic Linker"
EIPPQAII

SEQ ID NO: 4916 - protein, 27 aa, Artificial Sequence
  source: /note="Description of Artificial Sequence: Synthetic Linker"
ESGEPSSLPRPATHWPFKTAFQHHYLV

SEQ ID NO: 4917 - protein, 8 aa, Artificial Sequence
  source: /note="Description of Artificial Sequence: Synthetic Linker"
EVHYARPI

SEQ ID NO: 4918 - protein, 25 aa, Artificial Sequence
  source: /note="Description of Artificial Sequence: Synthetic Linker"
WSRLKAKDWGSSSGSQGREDSVLSY

SEQ ID NO: 4919 - protein, 4 aa, Artificial Sequence
  source: /note="Description of Artificial Sequence: Synthetic Linker"
LGTA

SEQ ID NO: 4920 - protein, 5 aa, Artificial Sequence
  source: /note="Description of Artificial Sequence: Synthetic Linker"
LGRRF

SEQ ID NO: 4921 - protein, 6 aa, Artificial Sequence
  source: /note="Description of Artificial Sequence: Synthetic Linker"
ANTDNT

SEQ ID NO: 4922 - protein, 6 aa, Artificial Sequence
  source: /note="Description of Artificial Sequence: Synthetic Linker"
KRTIPA

SEQ ID NO: 4923 - protein, 7 aa, Artificial Sequence
  source: /note="Description of Artificial Sequence: Synthetic Linker"
AIDDSNI

SEQ ID NO: 4924 - protein, 7 aa, Artificial Sequence
  source: /note="Description of Artificial Sequence: Synthetic Linker"
PLTKTDV

SEQ ID NO: 4925 - protein, 8 aa, Artificial Sequence
  source: /note="Description of Artificial Sequence: Synthetic Linker"
NYLVSDGI

SEQ ID NO: 4926 - protein, 9 aa, Artificial Sequence
  source: /note="Description of Artificial Sequence: Synthetic Linker"
LLDDEGFNW

SEQ ID NO: 4927 - protein, 4 aa, Artificial Sequence
  source: /note="Description of Artificial Sequence: Synthetic Linker"
TKAE

SEQ ID NO: 4928 - protein, 4 aa, Artificial Sequence
  source: /note="Description of Artificial Sequence: Synthetic Linker"
TVAV

SEQ ID NO: 4929 - protein, 4 aa, Artificial Sequence
  source: /note="Description of Artificial Sequence: Synthetic Linker"
YRTM

SEQ ID NO: 4930 - protein, 5 aa, Artificial Sequence
  source: /note="Description of Artificial Sequence: Synthetic Linker"
ARTPL

SEQ ID NO: 4931 - protein, 5 aa, Artificial Sequence
  source: /note="Description of Artificial Sequence: Synthetic Linker"
DRPDL

SEQ ID NO: 4932 - protein, 5 aa, Artificial Sequence
  source: /note="Description of Artificial Sequence: Synthetic Linker"
TGTAK

SEQ ID NO: 4933 - protein, 5 aa, Artificial Sequence
  source: /note="Description of Artificial Sequence: Synthetic Linker"
VAMQK

SEQ ID NO: 4934 - protein, 5 aa, Artificial Sequence
  source: /note="Description of Artificial Sequence: Synthetic Linker"
YNMQV

SEQ ID NO: 4935 - protein, 6 aa, Artificial Sequence
  source: /note="Description of Artificial Sequence: Synthetic Linker"
FRMYEK

SEQ ID NO: 4936 - protein, 6 aa, Artificial Sequence
  source: /note="Description of Artificial Sequence: Synthetic Linker"
QAAKST

SEQ ID NO: 4937 - protein, 7 aa, Artificial Sequence
  source: /note="Description of Artificial Sequence: Synthetic Linker"
YMTGQPV

SEQ ID NO: 4938 - protein, 8 aa, Artificial Sequence
  source: /note="Description of Artificial Sequence: Synthetic Linker"
VVEDGQVV

SEQ ID NO: 4939 - protein, 10 aa, Artificial Sequence
  source: /note="Description of Artificial Sequence: Synthetic Linker"
KEGLEIQNES

SEQ ID NO: 4940 - protein, 11 aa, Artificial Sequence
  source: /note="Description of Artificial Sequence: Synthetic Linker"
AFGIDNLFDVK

SEQ ID NO: 4941 - protein, 11 aa, Artificial Sequence
  source: /note="Description of Artificial Sequence: Synthetic Linker"
TIPTNRPVVRD

SEQ ID NO: 4942 - protein, 15 aa, Artificial Sequence
  source: /note="Description of Artificial Sequence: Synthetic Linker"
VDSFTGRLMKGRRYS

SEQ ID NO: 4943 - protein, 24 aa, Artificial Sequence
  source: /note="Description of Artificial Sequence: Synthetic Linker"
VRTLKAEKDYTYDIKTKAVQLTEE

SEQ ID NO: 4944 - protein, 12 aa, Artificial Sequence
  source: /note="Description of Artificial Sequence: Synthetic Linker"
DLPPLEEGRYYY

SEQ ID NO: 4945 - protein, 18 aa, Artificial Sequence
  source: /note="Description of Artificial Sequence: Synthetic Linker"
HGTALEHRRVVSPYGHRF

SEQ ID NO: 4946 - protein, 7 aa, Artificial Sequence
  source: /note="Description of Artificial Sequence: Synthetic Linker"
AEANVEY

SEQ ID NO: 4947 - protein, 9 aa, Artificial Sequence
  source: /note="Description of Artificial Sequence: Synthetic Linker"
IPLVTGPGV

SEQ ID NO: 4948 - protein, 4 aa, Artificial Sequence
  source: /note="Description of Artificial Sequence: Synthetic Linker"
INDV

SEQ ID NO: 4949 - protein, 4 aa, Artificial Sequence
  source: /note="Description of Artificial Sequence: Synthetic Linker"
KARL

SEQ ID NO: 4950 - protein, 5 aa, Artificial Sequence
  source: /note="Description of Artificial Sequence: Synthetic Linker"
HPEHG

SEQ ID NO: 4951 - protein, 5 aa, Artificial Sequence
  source: /note="Description of Artificial Sequence: Synthetic Linker"
YIGKP

SEQ ID NO: 4952 - protein, 7 aa, Artificial Sequence
  source: /note="Description of Artificial Sequence: Synthetic Linker"
YGYRRLR

SEQ ID NO: 4953 - protein, 8 aa, Artificial Sequence
  source: /note="Description of Artificial Sequence: Synthetic Linker"
EYLKRPLI

SEQ ID NO: 4954 - protein, 8 aa, Artificial Sequence
  source: /note="Description of Artificial Sequence: Synthetic Linker"
FADLPRKY

SEQ ID NO: 4955 - protein, 8 aa, Artificial Sequence
  source: /note="Description of Artificial Sequence: Synthetic Linker"
SGLQDVAH

SEQ ID NO: 4956 - protein, 13 aa, Artificial Sequence
  source: /note="Description of Artificial Sequence: Synthetic Linker"
VGGGLSTNPMLAQ

SEQ ID NO: 4957 - protein, 15 aa, Artificial Sequence
  source: /note="Description of Artificial Sequence: Synthetic Linker"
DDVGLQTTEACGDCP

SEQ ID NO: 4958 - protein, 16 aa, Artificial Sequence
  source: /note="Description of Artificial Sequence: Synthetic Linker"
DGPAPEPVKHPIDHVG

SEQ ID NO: 4959 - protein, 16 aa, Artificial Sequence
  source: /note="Description of Artificial Sequence: Synthetic Linker"
GSPLAGESLDEVLDPT

SEQ ID NO: 4960 - protein, 4 aa, Artificial Sequence
  source: /note="Description of Artificial Sequence: Synthetic Linker"
EVRE

SEQ ID NO: 4961 - protein, 4 aa, Artificial Sequence
  source: /note="Description of Artificial Sequence: Synthetic Linker"
HGEV

SEQ ID NO: 4962 - protein, 4 aa, Artificial Sequence
  source: /note="Description of Artificial Sequence: Synthetic Linker"
KLPP

SEQ ID NO: 4963 - protein, 6 aa, Artificial Sequence
  source: /note="Description of Artificial Sequence: Synthetic Linker"
FGREGN

SEQ ID NO: 4964 - protein, 6 aa, Artificial Sequence
  source: /note="Description of Artificial Sequence: Synthetic Linker"
LGKGSS

SEQ ID NO: 4965 - protein, 6 aa, Artificial Sequence
  source: /note="Description of Artificial Sequence: Synthetic Linker"
PFPKDV

SEQ ID NO: 4966 - protein, 6 aa, Artificial Sequence
  source: /note="Description of Artificial Sequence: Synthetic Linker"
SEHFGE

SEQ ID NO: 4967 - protein, 6 aa, Artificial Sequence
  source: /note="Description of Artificial Sequence: Synthetic Linker"
YTGVRR

SEQ ID NO: 4968 - protein, 7 aa, Artificial Sequence
  source: /note="Description of Artificial Sequence: Synthetic Linker"
DTHTLDY

SEQ ID NO: 4969 - protein, 8 aa, Artificial Sequence
  source: /note="Description of Artificial Sequence: Synthetic Linker"
ESDYEVGG

SEQ ID NO: 4970 - protein, 11 aa, Artificial Sequence
  source: /note="Description of Artificial Sequence: Synthetic Linker"
GNLPLGAGLSS

SEQ ID NO: 4971 - protein, 13 aa, Artificial Sequence
  source: /note="Description of Artificial Sequence: Synthetic Linker"
FSLNDLRKENSWI

SEQ ID NO: 4972 - protein, 9 aa, Artificial Sequence
  source: /note="Description of Artificial Sequence: Synthetic Linker"
EHGLAPPDR

SEQ ID NO: 4973 - protein, 12 aa, Artificial Sequence
  source: /note="Description of Artificial Sequence: Synthetic Linker"
AYPQTPLLPRDP

SEQ ID NO: 4974 - protein, 5 aa, Artificial Sequence
  source: /note="Description of Artificial Sequence: Synthetic Linker"
QFATV

SEQ ID NO: 4975 - protein, 4 aa, Artificial Sequence
  source: /note="Description of Artificial Sequence: Synthetic Linker"
LLTA

SEQ ID NO: 4976 - protein, 6 aa, Artificial Sequence
  source: /note="Description of Artificial Sequence: Synthetic Linker"
ARHPLL

SEQ ID NO: 4977 - protein, 6 aa, Artificial Sequence
  source: /note="Description of Artificial Sequence: Synthetic Linker"
LGGLEV

SEQ ID NO: 4978 - protein, 6 aa, Artificial Sequence
  source: /note="Description of Artificial Sequence: Synthetic Linker"
WTEGWE

SEQ ID NO: 4979 - protein, 7 aa, Artificial Sequence
  source: /note="Description of Artificial Sequence: Synthetic Linker"
YDEGLTS

SEQ ID NO: 4980 - protein, 8 aa, Artificial Sequence
  source: /note="Description of Artificial Sequence: Synthetic Linker"
TLGLRSPV

SEQ ID NO: 4981 - protein, 14 aa, Artificial Sequence
  source: /note="Description of Artificial Sequence: Synthetic Linker"
HLDLSAPKLRLREE

SEQ ID NO: 4982 - protein, 21 aa, Artificial Sequence
  source: /note="Description of Artificial Sequence: Synthetic Linker"
YATEKEEPKPERTEVVAKLRR

SEQ ID NO: 4983 - protein, 6 aa, Artificial Sequence
  source: /note="Description of Artificial Sequence: Synthetic Linker"
ELGVSL

SEQ ID NO: 4984 - protein, 6 aa, Artificial Sequence
  source: /note="Description of Artificial Sequence: Synthetic Linker"
MSSKGT

SEQ ID NO: 4985 - protein, 7 aa, Artificial Sequence
  source: /note="Description of Artificial Sequence: Synthetic Linker"
LKLGRAF

SEQ ID NO: 4986 - protein, 8 aa, Artificial Sequence
  source: /note="Description of Artificial Sequence: Synthetic Linker"
GFNIEKFP

SEQ ID NO: 4987 - protein, 15 aa, Artificial Sequence
  source: /note="Description of Artificial Sequence: Synthetic Linker"
TAPLPGYNTEFASGI

SEQ ID NO: 4988 - protein, 22 aa, Artificial Sequence
  source: /note="Description of Artificial Sequence: Synthetic Linker"
CFRNEVGLPDSSKTEKVTSETV

SEQ ID NO: 4989 - protein, 4 aa, Artificial Sequence
  source: /note="Description of Artificial Sequence: Synthetic Linker"
KSRT

SEQ ID NO: 4990 - protein, 5 aa, Artificial Sequence
  source: /note="Description of Artificial Sequence: Synthetic Linker"
DRAGA

SEQ ID NO: 4991 - protein, 5 aa, Artificial Sequence
  source: /note="Description of Artificial Sequence: Synthetic Linker"
FYVSA

SEQ ID NO: 4992 - protein, 5 aa, Artificial Sequence
  source: /note="Description of Artificial Sequence: Synthetic Linker"
IATGG

SEQ ID NO: 4993 - protein, 5 aa, Artificial Sequence
  source: /note="Description of Artificial Sequence: Synthetic Linker"
IGGGT

SEQ ID NO: 4994 - protein, 5 aa, Artificial Sequence
  source: /note="Description of Artificial Sequence: Synthetic Linker"
LFRKI

SEQ ID NO: 4995 - protein, 5 aa, Artificial Sequence
  source: /note="Description of Artificial Sequence: Synthetic Linker"
PRSLS

SEQ ID NO: 4996 - protein, 5 aa, Artificial Sequence
  source: /note="Description of Artificial Sequence: Synthetic Linker"
TGKKV

SEQ ID NO: 4997 - protein, 6 aa, Artificial Sequence
  source: /note="Description of Artificial Sequence: Synthetic Linker"
DVRGNM

SEQ ID NO: 4998 - protein, 6 aa, Artificial Sequence
  source: /note="Description of Artificial Sequence: Synthetic Linker"
LNDGSQ

SEQ ID NO: 4999 - protein, 6 aa, Artificial Sequence
  source: /note="Description of Artificial Sequence: Synthetic Linker"
NIENGG

SEQ ID NO: 5000 - protein, 6 aa, Artificial Sequence
  source: /note="Description of Artificial Sequence: Synthetic Linker"
RDPGAR

SEQ ID NO: 5001 - protein, 6 aa, Artificial Sequence
  source: /note="Description of Artificial Sequence: Synthetic Linker"
SREVKS

SEQ ID NO: 5002 - protein, 7 aa, Artificial Sequence
  source: /note="Description of Artificial Sequence: Synthetic Linker"
RQWNGKE

SEQ ID NO: 5003 - protein, 7 aa, Artificial Sequence
  source: /note="Description of Artificial Sequence: Synthetic Linker"
SIYFQPP

SEQ ID NO: 5004 - protein, 8 aa, Artificial Sequence
  source: /note="Description of Artificial Sequence: Synthetic Linker"
VPQIRAPS

SEQ ID NO: 5005 - protein, 8 aa, Artificial Sequence
  source: /note="Description of Artificial Sequence: Synthetic Linker"
WFSDDPNV

SEQ ID NO: 5006 - protein, 11 aa, Artificial Sequence
  source: /note="Description of Artificial Sequence: Synthetic Linker"
SEDPELPYMRP

SEQ ID NO: 5007 - protein, 8 aa, Artificial Sequence
  source: /note="Description of Artificial Sequence: Synthetic Linker"
AFDGPFDE

SEQ ID NO: 5008 - protein, 6 aa, Artificial Sequence
  source: /note="Description of Artificial Sequence: Synthetic Linker"
HGDDRG

SEQ ID NO: 5009 - protein, 5 aa, Artificial Sequence
  source: /note="Description of Artificial Sequence: Synthetic Linker"
LRPSP

SEQ ID NO: 5010 - protein, 4 aa, Artificial Sequence
  source: /note="Description of Artificial Sequence: Synthetic Linker"
LNVA

SEQ ID NO: 5011 - protein, 6 aa, Artificial Sequence
  source: /note="Description of Artificial Sequence: Synthetic Linker"
LSTSQK

SEQ ID NO: 5012 - protein, 21 aa, Artificial Sequence
  source: /note="Description of Artificial Sequence: Synthetic Linker"
GAADIGLGYPNGNQGWGRVTL

SEQ ID NO: 5013 - protein, 4 aa, Artificial Sequence
  source: /note="Description of Artificial Sequence: Synthetic Linker"
YIGI

SEQ ID NO: 5014 - protein, 7 aa, Artificial Sequence
  source: /note="Description of Artificial Sequence: Synthetic Linker"
DGRVIRG

SEQ ID NO: 5015 - protein, 17 aa, Artificial Sequence
  source: /note="Description of Artificial Sequence: Synthetic Linker"
TLSFDKSNDGETPEGIG

SEQ ID NO: 5016 - protein, 18 aa, Artificial Sequence
  source: /note="Description of Artificial Sequence: Synthetic Linker"
EIAPLHAQGGGIDQLQGI

SEQ ID NO: 5017 - protein, 4 aa, Artificial Sequence
  source: /note="Description of Artificial Sequence: Synthetic Linker"
ANNG

SEQ ID NO: 5018 - protein, 4 aa, Artificial Sequence
  source: /note="Description of Artificial Sequence: Synthetic Linker"
ESNL

SEQ ID NO: 5019 - protein, 4 aa, Artificial Sequence
  source: /note="Description of Artificial Sequence: Synthetic Linker"
KISA

SEQ ID NO: 5020 - protein, 4 aa, Artificial Sequence
  source: /note="Description of Artificial Sequence: Synthetic Linker"
MDSA

SEQ ID NO: 5021 - protein, 4 aa, Artificial Sequence
  source: /note="Description of Artificial Sequence: Synthetic Linker"
MMTP

SEQ ID NO: 5022 - protein, 4 aa, Artificial Sequence
  source: /note="Description of Artificial Sequence: Synthetic Linker"
VGGI

SEQ ID NO: 5023 - protein, 5 aa, Artificial Sequence
  source: /note="Description of Artificial Sequence: Synthetic Linker"
YTQRL

SEQ ID NO: 5024 - protein, 6 aa, Artificial Sequence
  source: /note="Description of Artificial Sequence: Synthetic Linker"
AEKGKA

SEQ ID NO: 5025 - protein, 6 aa, Artificial Sequence
  source: /note="Description of Artificial Sequence: Synthetic Linker"
MIRVPV

SEQ ID NO: 5026 - protein, 7 aa, Artificial Sequence
  source: /note="Description of Artificial Sequence: Synthetic Linker"
SYTATED

SEQ ID NO: 5027 - protein, 8 aa, Artificial Sequence
  source: /note="Description of Artificial Sequence: Synthetic Linker"
ETINPAHP

SEQ ID NO: 5028 - protein, 8 aa, Artificial Sequence
  source: /note="Description of Artificial Sequence: Synthetic Linker"
SKFSGGNL

SEQ ID NO: 5029 - protein, 8 aa, Artificial Sequence
  source: /note="Description of Artificial Sequence: Synthetic Linker"
TAYFVDAP

SEQ ID NO: 5030 - protein, 9 aa, Artificial Sequence
  source: /note="Description of Artificial Sequence: Synthetic Linker"
ISPKEPHNK

SEQ ID NO: 5031 - protein, 9 aa, Artificial Sequence
  source: /note="Description of Artificial Sequence: Synthetic Linker"
LSDKPGNPV

SEQ ID NO: 5032 - protein, 9 aa, Artificial Sequence
  source: /note="Description of Artificial Sequence: Synthetic Linker"
RYPSITRDM

SEQ ID NO: 5033 - protein, 10 aa, Artificial Sequence
  source: /note="Description of Artificial Sequence: Synthetic Linker"
MLSQVPYFSR

SEQ ID NO: 5034 - protein, 11 aa, Artificial Sequence
  source: /note="Description of Artificial Sequence: Synthetic Linker"
APSRYFASEPK

SEQ ID NO: 5035 - protein, 14 aa, Artificial Sequence
  source: /note="Description of Artificial Sequence: Synthetic Linker"
HTLDAVNIADRYDA

SEQ ID NO: 5036 - protein, 31 aa, Artificial Sequence
  source: /note="Description of Artificial Sequence: Synthetic Linker"
ADIALSLPELNPYIPDDFSLIKSEKKYDHPE

SEQ ID NO: 5037 - protein, 7 aa, Artificial Sequence
  source: /note="Description of Artificial Sequence: Synthetic Linker"
DVQPMQY

SEQ ID NO: 5038 - protein, 11 aa, Artificial Sequence
  source: /note="Description of Artificial Sequence: Synthetic Linker"
HMSPSWTLLKL

SEQ ID NO: 5039 - protein, 8 aa, Artificial Sequence
  source: /note="Description of Artificial Sequence: Synthetic Linker"
LEMVSKPM

SEQ ID NO: 5040 - protein, 51 aa, Artificial Sequence
  source: /note="Description of Artificial Sequence: Synthetic Linker"
YGPKGKGKGMGAGTLSTDKGESLGIKYEEGQSHRPTNPNASRMAQKVGGSD

SEQ ID NO: 5041 - protein, 5 aa, Artificial Sequence
  source: /note="Description of Artificial Sequence: Synthetic Linker"
VGQSL

SEQ ID NO: 5042 - protein, 6 aa, Artificial Sequence
  source: /note="Description of Artificial Sequence: Synthetic Linker"
VSRSST

SEQ ID NO: 5043 - protein, 12 aa, Artificial Sequence
  source: /note="Description of Artificial Sequence: Synthetic Linker"
ERNDVAPNKPDE

SEQ ID NO: 5044 - protein, 12 aa, Artificial Sequence
  source: /note="Description of Artificial Sequence: Synthetic Linker"
TETAAAADPGLS

SEQ ID NO: 5045 - protein, 14 aa, Artificial Sequence
  source: /note="Description of Artificial Sequence: Synthetic Linker"
VAESDRPELTSARR

SEQ ID NO: 5046 - protein, 4 aa, Artificial Sequence
  source: /note="Description of Artificial Sequence: Synthetic Linker"
PFYP

SEQ ID NO: 5047 - protein, 6 aa, Artificial Sequence
  source: /note="Description of Artificial Sequence: Synthetic Linker"
GVSEKP

SEQ ID NO: 5048 - protein, 9 aa, Artificial Sequence
  source: /note="Description of Artificial Sequence: Synthetic Linker"
LGMGDVASL

SEQ ID NO: 5049 - protein, 15 aa, Artificial Sequence
  source: /note="Description of Artificial Sequence: Synthetic Linker"
ALGGEARLPVLKDRN

SEQ ID NO: 5050 - protein, 17 aa, Artificial Sequence
  source: /note="Description of Artificial Sequence: Synthetic Linker"
AAGLEAEAPKSAKELSL

SEQ ID NO: 5051 - protein, 4 aa, Artificial Sequence
  source: /note="Description of Artificial Sequence: Synthetic Linker"
KGRF

SEQ ID NO: 5052 - protein, 5 aa, Artificial Sequence
  source: /note="Description of Artificial Sequence: Synthetic Linker"
KAGSL

SEQ ID NO: 5053 - protein, 6 aa, Artificial Sequence
  source: /note="Description of Artificial Sequence: Synthetic Linker"
NTGIFI

SEQ ID NO: 5054 - protein, 6 aa, Artificial Sequence
  source: /note="Description of Artificial Sequence: Synthetic Linker"
QLVKSE

SEQ ID NO: 5055 - protein, 7 aa, Artificial Sequence
  source: /note="Description of Artificial Sequence: Synthetic Linker"
KLKYVPH

SEQ ID NO: 5056 - protein, 7 aa, Artificial Sequence
  source: /note="Description of Artificial Sequence: Synthetic Linker"
LGFDEVI

SEQ ID NO: 5057 - protein, 9 aa, Artificial Sequence
  source: /note="Description of Artificial Sequence: Synthetic Linker"
MLATNLTDK

SEQ ID NO: 5058 - protein, 16 aa, Artificial Sequence
  source: /note="Description of Artificial Sequence: Synthetic Linker"
LKDHILQFVIPNRGVT

SEQ ID NO: 5059 - protein, 17 aa, Artificial Sequence
  source: /note="Description of Artificial Sequence: Synthetic Linker"
RAKGSTKFTRVPKRVYW

SEQ ID NO: 5060 - protein, 5 aa, Artificial Sequence
  source: /note="Description of Artificial Sequence: Synthetic Linker"
FQKLM

SEQ ID NO: 5061 - protein, 6 aa, Artificial Sequence
  source: /note="Description of Artificial Sequence: Synthetic Linker"
NAPTPQ

SEQ ID NO: 5062 - protein, 8 aa, Artificial Sequence
  source: /note="Description of Artificial Sequence: Synthetic Linker"
EFKEGEDA

SEQ ID NO: 5063 - protein, 6 aa, Artificial Sequence
  source: /note="Description of Artificial Sequence: Synthetic Linker"
AGTLLP

SEQ ID NO: 5064 - protein, 6 aa, Artificial Sequence
  source: /note="Description of Artificial Sequence: Synthetic Linker"
LAPYKV

SEQ ID NO: 5065 - protein, 7 aa, Artificial Sequence
  source: /note="Description of Artificial Sequence: Synthetic Linker"
ESIKDDK

SEQ ID NO: 5066 - protein, 7 aa, Artificial Sequence
  source: /note="Description of Artificial Sequence: Synthetic Linker"
FHDKPEI

SEQ ID NO: 5067 - protein, 8 aa, Artificial Sequence
  source: /note="Description of Artificial Sequence: Synthetic Linker"
ITTPKDDE

SEQ ID NO: 5068 - protein, 9 aa, Artificial Sequence
  source: /note="Description of Artificial Sequence: Synthetic Linker"
HDITPSMTP

SEQ ID NO: 5069 - protein, 10 aa, Artificial Sequence
  source: /note="Description of Artificial Sequence: Synthetic Linker"
AEATVAPVSP

SEQ ID NO: 5070 - protein, 11 aa, Artificial Sequence
  source: /note="Description of Artificial Sequence: Synthetic Linker"
IDALADKYEPS

SEQ ID NO: 5071 - protein, 4 aa, Artificial Sequence
  source: /note="Description of Artificial Sequence: Synthetic Linker"
FYGK

SEQ ID NO: 5072 - protein, 8 aa, Artificial Sequence
  source: /note="Description of Artificial Sequence: Synthetic Linker"
ALSNTGEI

SEQ ID NO: 5073 - protein, 15 aa, Artificial Sequence
  source: /note="Description of Artificial Sequence: Synthetic Linker"
TATPPGSVTVPHPNI

SEQ ID NO: 5074 - protein, 19 aa, Artificial Sequence
  source: /note="Description of Artificial Sequence: Synthetic Linker"
RSPVFTDNSSPPAVPQSFQ

SEQ ID NO: 5075 - protein, 8 aa, Artificial Sequence
  source: /note="Description of Artificial Sequence: Synthetic Linker"
IRNIDQDV

SEQ ID NO: 5076 - protein, 8 aa, Artificial Sequence
  source: /note="Description of Artificial Sequence: Synthetic Linker"
REETNLMD

SEQ ID NO: 5077 - protein, 6 aa, Artificial Sequence
  source: /note="Description of Artificial Sequence: Synthetic Linker"
HALPLV

SEQ ID NO: 5078 - protein, 6 aa, Artificial Sequence
  source: /note="Description of Artificial Sequence: Synthetic Linker"
EGRSKK

SEQ ID NO: 5079 - protein, 27 aa, Artificial Sequence
  source: /note="Description of Artificial Sequence: Synthetic Linker"
NKEKKAVSPLLLTTTNSSEGLSMGNYI

SEQ ID NO: 5080 - protein, 7 aa, Artificial Sequence
  source: /note="Description of Artificial Sequence: Synthetic Linker"
DLASGQI

SEQ ID NO: 5081 - protein, 7 aa, Artificial Sequence
  source: /note="Description of Artificial Sequence: Synthetic Linker"
TLANGAV

SEQ ID NO: 5082 - protein, 8 aa, Artificial Sequence
  source: /note="Description of Artificial Sequence: Synthetic Linker"
DYDGYNQF

SEQ ID NO: 5083 - protein, 9 aa, Artificial Sequence
  source: /note="Description of Artificial Sequence: Synthetic Linker"
DTGGAPGTV

SEQ ID NO: 5084 - protein, 9 aa, Artificial Sequence
  source: /note="Description of Artificial Sequence: Synthetic Linker"
QTNGGQFPY

SEQ ID NO: 5085 - protein, 10 aa, Artificial Sequence
  source: /note="Description of Artificial Sequence: Synthetic Linker"
TGIKGAFRTR

SEQ ID NO: 5086 - protein, 5 aa, Artificial Sequence
  source: /note="Description of Artificial Sequence: Synthetic Linker"
SLPAR

SEQ ID NO: 5087 - protein, 4 aa, Artificial Sequence
  source: /note="Description of Artificial Sequence: Synthetic Linker"
IYPD

SEQ ID NO: 5088 - protein, 4 aa, Artificial Sequence
  source: /note="Description of Artificial Sequence: Synthetic Linker"
KCAV

SEQ ID NO: 5089 - protein, 4 aa, Artificial Sequence
  source: /note="Description of Artificial Sequence: Synthetic Linker"
MAPK

SEQ ID NO: 5090 - protein, 4 aa, Artificial Sequence
  source: /note="Description of Artificial Sequence: Synthetic Linker"
TESL

SEQ ID NO: 5091 - protein, 5 aa, Artificial Sequence
  source: /note="Description of Artificial Sequence: Synthetic Linker"
ASADQ

SEQ ID NO: 5092 - protein, 10 aa, Artificial Sequence
  source: /note="Description of Artificial Sequence: Synthetic Linker"
YTLRQPPPAT

SEQ ID NO: 5093 - protein, 11 aa, Artificial Sequence
  source: /note="Description of Artificial Sequence: Synthetic Linker"
DQSDPNDPKSR

SEQ ID NO: 5094 - protein, 24 aa, Artificial Sequence
  source: /note="Description of Artificial Sequence: Synthetic Linker"
SLHDMADEAGLPVQTEDGEATGTI

SEQ ID NO: 5095 - protein, 5 aa, Artificial Sequence
  source: /note="Description of Artificial Sequence: Synthetic Linker"
DGIEE

SEQ ID NO: 5096 - protein, 6 aa, Artificial Sequence
  source: /note="Description of Artificial Sequence: Synthetic Linker"
VEHLPK

SEQ ID NO: 5097 - protein, 4 aa, Artificial Sequence
  source: /note="Description of Artificial Sequence: Synthetic Linker"
QAHS

SEQ ID NO: 5098 - protein, 7 aa, Artificial Sequence
  source: /note="Description of Artificial Sequence: Synthetic Linker"
AKEAFVS

SEQ ID NO: 5099 - protein, 9 aa, Artificial Sequence
  source: /note="Description of Artificial Sequence: Synthetic Linker"
QGILLHRSR

SEQ ID NO: 5100 - protein, 4 aa, Artificial Sequence
  source: /note="Description of Artificial Sequence: Synthetic Linker"
ESEY

SEQ ID NO: 5101 - protein, 5 aa, Artificial Sequence
  source: /note="Description of Artificial Sequence: Synthetic Linker"
DGPTP

SEQ ID NO: 5102 - protein, 8 aa, Artificial Sequence
  source: /note="Description of Artificial Sequence: Synthetic Linker"
VGSEKVSK

SEQ ID NO: 5103 - protein, 4 aa, Artificial Sequence
  source: /note="Description of Artificial Sequence: Synthetic Linker"
IGQS

SEQ ID NO: 5104 - protein, 15 aa, Artificial Sequence
  source: /note="Description of Artificial Sequence: Synthetic Linker"
VSNINNTVSPSSASF

SEQ ID NO: 5105 - protein, 16 aa, Artificial Sequence
  source: /note="Description of Artificial Sequence: Synthetic Linker"
ALPTNARPLLPPISNP

SEQ ID NO: 5106 - protein, 8 aa, Artificial Sequence
  source: /note="Description of Artificial Sequence: Synthetic Linker"
VRERPVPR

SEQ ID NO: 5107 - protein, 9 aa, Artificial Sequence
  source: /note="Description of Artificial Sequence: Synthetic Linker"
EQADGAVRG

SEQ ID NO: 5108 - protein, 13 aa, Artificial Sequence
  source: /note="Description of Artificial Sequence: Synthetic Linker"
ARSGYRPDSGATP

SEQ ID NO: 5109 - protein, 8 aa, Artificial Sequence
  source: /note="Description of Artificial Sequence: Synthetic Linker"
PDIDKLGY

SEQ ID NO: 5110 - protein, 5 aa, Artificial Sequence
  source: /note="Description of Artificial Sequence: Synthetic Linker"
LGYSM

SEQ ID NO: 5111 - protein, 13 aa, Artificial Sequence
  source: /note="Description of Artificial Sequence: Synthetic Linker"
SGVIKKFTAIIDP

SEQ ID NO: 5112 - protein, 6 aa, Artificial Sequence
  source: /note="Description of Artificial Sequence: Synthetic Linker"
RTSRQL

SEQ ID NO: 5113 - protein, 4 aa, Artificial Sequence
  source: /note="Description of Artificial Sequence: Synthetic Linker"
SGCK

SEQ ID NO: 5114 - protein, 5 aa, Artificial Sequence
  source: /note="Description of Artificial Sequence: Synthetic Linker"
VSTGV

SEQ ID NO: 5115 - protein, 10 aa, Artificial Sequence
  source: /note="Description of Artificial Sequence: Synthetic Linker"
QALDGDITDM

SEQ ID NO: 5116 - protein, 8 aa, Artificial Sequence
  source: /note="Description of Artificial Sequence: Synthetic Linker"
HTAGSIPM

SEQ ID NO: 5117 - protein, 8 aa, Artificial Sequence
  source: /note="Description of Artificial Sequence: Synthetic Linker"
WEGHVPHY

SEQ ID NO: 5118 - protein, 9 aa, Artificial Sequence
  source: /note="Description of Artificial Sequence: Synthetic Linker"
VEGKREEAL

SEQ ID NO: 5119 - protein, 13 aa, Artificial Sequence
  source: /note="Description of Artificial Sequence: Synthetic Linker"
PMQTFSKQREVDF

SEQ ID NO: 5120 - protein, 10 aa, Artificial Sequence
  source: /note="Description of Artificial Sequence: Synthetic Linker"
VYFNERINVD

SEQ ID NO: 5121 - protein, 6 aa, Artificial Sequence
  source: /note="Description of Artificial Sequence: Synthetic Linker"
SGGPAT

SEQ ID NO: 5122 - protein, 8 aa, Artificial Sequence
  source: /note="Description of Artificial Sequence: Synthetic Linker"
YAATSTGR

SEQ ID NO: 5123 - protein, 9 aa, Artificial Sequence
  source: /note="Description of Artificial Sequence: Synthetic Linker"
TGGTEAAGG

SEQ ID NO: 5124 - protein, 6 aa, Artificial Sequence
  source: /note="Description of Artificial Sequence: Synthetic Linker"
FDPTEF

SEQ ID NO: 5125 - protein, 7 aa, Artificial Sequence
  source: /note="Description of Artificial Sequence: Synthetic Linker"
VDLDFNR

SEQ ID NO: 5126 - protein, 10 aa, Artificial Sequence
  source: /note="Description of Artificial Sequence: Synthetic Linker"
SNDAGFAMTS

SEQ ID NO: 5127 - protein, 11 aa, Artificial Sequence
  source: /note="Description of Artificial Sequence: Synthetic Linker"
NGFDPATGDLS

SEQ ID NO: 5128 - protein, 8 aa, Artificial Sequence
  source: /note="Description of Artificial Sequence: Synthetic Linker"
FSQPAPDR

SEQ ID NO: 5129 - protein, 5 aa, Artificial Sequence
  source: /note="Description of Artificial Sequence: Synthetic Linker"
CQPNE

SEQ ID NO: 5130 - protein, 5 aa, Artificial Sequence
  source: /note="Description of Artificial Sequence: Synthetic Linker"
KGVPC

SEQ ID NO: 5131 - protein, 5 aa, Artificial Sequence
  source: /note="Description of Artificial Sequence: Synthetic Linker"
PFITE

SEQ ID NO: 5132 - protein, 6 aa, Artificial Sequence
  source: /note="Description of Artificial Sequence: Synthetic Linker"
SIPTCE

SEQ ID NO: 5133 - protein, 6 aa, Artificial Sequence
  source: /note="Description of Artificial Sequence: Synthetic Linker"
VEEHNI

SEQ ID NO: 5134 - protein, 7 aa, Artificial Sequence
  source: /note="Description of Artificial Sequence: Synthetic Linker"
SNKEVIQ

SEQ ID NO: 5135 - protein, 7 aa, Artificial Sequence
  source: /note="Description of Artificial Sequence: Synthetic Linker"
TAKGDTK

SEQ ID NO: 5136 - protein, 9 aa, Artificial Sequence
  source: /note="Description of Artificial Sequence: Synthetic Linker"
GRWYPAFAD

SEQ ID NO: 5137 - protein, 16 aa, Artificial Sequence
  source: /note="Description of Artificial Sequence: Synthetic Linker"
IFYDFLHVNVIPTVSF

SEQ ID NO: 5138 - protein, 5 aa, Artificial Sequence
  source: /note="Description of Artificial Sequence: Synthetic Linker"
PGPAS

SEQ ID NO: 5139 - protein, 7 aa, Artificial Sequence
  source: /note="Description of Artificial Sequence: Synthetic Linker"
KVSKKTG

SEQ ID NO: 5140 - protein, 8 aa, Artificial Sequence
  source: /note="Description of Artificial Sequence: Synthetic Linker"
ACNIASMP

SEQ ID NO: 5141 - protein, 8 aa, Artificial Sequence
  source: /note="Description of Artificial Sequence: Synthetic Linker"
FNDEASDE

SEQ ID NO: 5142 - protein, 18 aa, Artificial Sequence
  source: /note="Description of Artificial Sequence: Synthetic Linker"
SLNAGELKKAAPADPSAP

SEQ ID NO: 5143 - protein, 10 aa, Artificial Sequence
  source: /note="Description of Artificial Sequence: Synthetic Linker"
DKYYMASPDL

SEQ ID NO: 5144 - protein, 10 aa, Artificial Sequence
  source: /note="Description of Artificial Sequence: Synthetic Linker"
NATNATQPIH

SEQ ID NO: 5145 - protein, 4 aa, Artificial Sequence
  source: /note="Description of Artificial Sequence: Synthetic Linker"
EFPP

SEQ ID NO: 5146 - protein, 9 aa, Artificial Sequence
  source: /note="Description of Artificial Sequence: Synthetic Linker"
ENELMYGVP

SEQ ID NO: 5147 - protein, 13 aa, Artificial Sequence
  source: /note="Description of Artificial Sequence: Synthetic Linker"
QSKDFLIPIGKAK

SEQ ID NO: 5148 - protein, 4 aa, Artificial Sequence
  source: /note="Description of Artificial Sequence: Synthetic Linker"
AGEV

SEQ ID NO: 5149 - protein, 4 aa, Artificial Sequence
  source: /note="Description of Artificial Sequence: Synthetic Linker"
LHPT

SEQ ID NO: 5150 - protein, 4 aa, Artificial Sequence
  source: /note="Description of Artificial Sequence: Synthetic Linker"
RIEA

SEQ ID NO: 5151 - protein, 4 aa, Artificial Sequence
  source: /note="Description of Artificial Sequence: Synthetic Linker"
SPGA

SEQ ID NO: 5152 - protein, 4 aa, Artificial Sequence
  source: /note="Description of Artificial Sequence: Synthetic Linker"
YFTA

SEQ ID NO: 5153 - protein, 6 aa, Artificial Sequence
  source: /note="Description of Artificial Sequence: Synthetic Linker"
DGSTGK

SEQ ID NO: 5154 - protein, 6 aa, Artificial Sequence
  source: /note="Description of Artificial Sequence: Synthetic Linker"
EKGERV

SEQ ID NO: 5155 - protein, 6 aa, Artificial Sequence
  source: /note="Description of Artificial Sequence: Synthetic Linker"
KGDIET

SEQ ID NO: 5156 - protein, 7 aa, Artificial Sequence
  source: /note="Description of Artificial Sequence: Synthetic Linker"
DEGMITE

SEQ ID NO: 5157 - protein, 7 aa, Artificial Sequence
  source: /note="Description of Artificial Sequence: Synthetic Linker"
QEASVSG

SEQ ID NO: 5158 - protein, 4 aa, Artificial Sequence
  source: /note="Description of Artificial Sequence: Synthetic Linker"
EAAN

SEQ ID NO: 5159 - protein, 4 aa, Artificial Sequence
  source: /note="Description of Artificial Sequence: Synthetic Linker"
RYGL

SEQ ID NO: 5160 - protein, 5 aa, Artificial Sequence
  source: /note="Description of Artificial Sequence: Synthetic Linker"
EVLDY

SEQ ID NO: 5161 - protein, 5 aa, Artificial Sequence
  source: /note="Description of Artificial Sequence: Synthetic Linker"
RPFVS

SEQ ID NO: 5162 - protein, 5 aa, Artificial Sequence
  source: /note="Description of Artificial Sequence: Synthetic Linker"
SLVNQ

SEQ ID NO: 5163 - protein, 5 aa, Artificial Sequence
  source: /note="Description of Artificial Sequence: Synthetic Linker"
SMGSS

SEQ ID NO: 5164 - protein, 6 aa, Artificial Sequence
  source: /note="Description of Artificial Sequence: Synthetic Linker"
SKEFSP

SEQ ID NO: 5165 - protein, 7 aa, Artificial Sequence
  source: /note="Description of Artificial Sequence: Synthetic Linker"
AAKGEKI

SEQ ID NO: 5166 - protein, 7 aa, Artificial Sequence
  source: /note="Description of Artificial Sequence: Synthetic Linker"
GAPDAER

SEQ ID NO: 5167 - protein, 7 aa, Artificial Sequence
  source: /note="Description of Artificial Sequence: Synthetic Linker"
RGEAMPK

SEQ ID NO: 5168 - protein, 8 aa, Artificial Sequence
  source: /note="Description of Artificial Sequence: Synthetic Linker"
SGAKKNHF

SEQ ID NO: 5169 - protein, 8 aa, Artificial Sequence
  source: /note="Description of Artificial Sequence: Synthetic Linker"
TGRSYKLF

SEQ ID NO: 5170 - protein, 9 aa, Artificial Sequence
  source: /note="Description of Artificial Sequence: Synthetic Linker"
AALPASAKV

SEQ ID NO: 5171 - protein, 9 aa, Artificial Sequence
  source: /note="Description of Artificial Sequence: Synthetic Linker"
DGFRTSHEI

SEQ ID NO: 5172 - protein, 10 aa, Artificial Sequence
  source: /note="Description of Artificial Sequence: Synthetic Linker"
KSMNPEHPHV

SEQ ID NO: 5173 - protein, 10 aa, Artificial Sequence
  source: /note="Description of Artificial Sequence: Synthetic Linker"
RGTAQNPDIY

SEQ ID NO: 5174 - protein, 11 aa, Artificial Sequence
  source: /note="Description of Artificial Sequence: Synthetic Linker"
WVPENCIQCNQ

SEQ ID NO: 5175 - protein, 12 aa, Artificial Sequence
  source: /note="Description of Artificial Sequence: Synthetic Linker"
DRTKEPGAPGDP

SEQ ID NO: 5176 - protein, 28 aa, Artificial Sequence
  source: /note="Description of Artificial Sequence: Synthetic Linker"
TVGIEDDVTGTSLPVDNAFADTTPKGTI

SEQ ID NO: 5177 - protein, 4 aa, Artificial Sequence
  source: /note="Description of Artificial Sequence: Synthetic Linker"
AGED

SEQ ID NO: 5178 - protein, 4 aa, Artificial Sequence
  source: /note="Description of Artificial Sequence: Synthetic Linker"
DADS

SEQ ID NO: 5179 - protein, 4 aa, Artificial Sequence
  source: /note="Description of Artificial Sequence: Synthetic Linker"
DGTV

SEQ ID NO: 5180 - protein, 4 aa, Artificial Sequence
  source: /note="Description of Artificial Sequence: Synthetic Linker"
QDGR

SEQ ID NO: 5181 - protein, 5 aa, Artificial Sequence
  source: /note="Description of Artificial Sequence: Synthetic Linker"
LGAGE

SEQ ID NO: 5182 - protein, 5 aa, Artificial Sequence
  source: /note="Description of Artificial Sequence: Synthetic Linker"
QPGRG

SEQ ID NO: 5183 - protein, 6 aa, Artificial Sequence
  source: /note="Description of Artificial Sequence: Synthetic Linker"
DFADGS

SEQ ID NO: 5184 - protein, 6 aa, Artificial Sequence
  source: /note="Description of Artificial Sequence: Synthetic Linker"
YDRPDR

SEQ ID NO: 5185 - protein, 7 aa, Artificial Sequence
  source: /note="Description of Artificial Sequence: Synthetic Linker"
KADAAPQ

SEQ ID NO: 5186 - protein, 15 aa, Artificial Sequence
  source: /note="Description of Artificial Sequence: Synthetic Linker"
PLGEAPDAYADDASG

SEQ ID NO: 5187 - protein, 4 aa, Artificial Sequence
  source: /note="Description of Artificial Sequence: Synthetic Linker"
PCFP

SEQ ID NO: 5188 - protein, 7 aa, Artificial Sequence
  source: /note="Description of Artificial Sequence: Synthetic Linker"
DLESPVK

SEQ ID NO: 5189 - protein, 7 aa, Artificial Sequence
  source: /note="Description of Artificial Sequence: Synthetic Linker"
FLRIQNV

SEQ ID NO: 5190 - protein, 10 aa, Artificial Sequence
  source: /note="Description of Artificial Sequence: Synthetic Linker"
LGHPCTRTPH

SEQ ID NO: 5191 - protein, 6 aa, Artificial Sequence
  source: /note="Description of Artificial Sequence: Synthetic Linker"
HFPKTF

SEQ ID NO: 5192 - protein, 7 aa, Artificial Sequence
  source: /note="Description of Artificial Sequence: Synthetic Linker"
RKLLGVK

SEQ ID NO: 5193 - protein, 7 aa, Artificial Sequence
  source: /note="Description of Artificial Sequence: Synthetic Linker"
SATPIPR

SEQ ID NO: 5194 - protein, 8 aa, Artificial Sequence
  source: /note="Description of Artificial Sequence: Synthetic Linker"
FYGDLDVT

SEQ ID NO: 5195 - protein, 8 aa, Artificial Sequence
  source: /note="Description of Artificial Sequence: Synthetic Linker"
SLPFKLTN

SEQ ID NO: 5196 - protein, 9 aa, Artificial Sequence
  source: /note="Description of Artificial Sequence: Synthetic Linker"
CSLKETLPE

SEQ ID NO: 5197 - protein, 9 aa, Artificial Sequence
  source: /note="Description of Artificial Sequence: Synthetic Linker"
ISEKPMNRL

SEQ ID NO: 5198 - protein, 9 aa, Artificial Sequence
  source: /note="Description of Artificial Sequence: Synthetic Linker"
TMLVPMDRV

SEQ ID NO: 5199 - protein, 10 aa, Artificial Sequence
  source: /note="Description of Artificial Sequence: Synthetic Linker"
IYRLTSGISQ

SEQ ID NO: 5200 - protein, 11 aa, Artificial Sequence
  source: /note="Description of Artificial Sequence: Synthetic Linker"
HGGIPKKIEGK

SEQ ID NO: 5201 - protein, 12 aa, Artificial Sequence
  source: /note="Description of Artificial Sequence: Synthetic Linker"
IDEMPPGRKEVQ

SEQ ID NO: 5202 - protein, 12 aa, Artificial Sequence
  source: /note="Description of Artificial Sequence: Synthetic Linker"
TPKEGEYVRRIL

SEQ ID NO: 5203 - protein, 9 aa, Artificial Sequence
  source: /note="Description of Artificial Sequence: Synthetic Linker"
KSDYTQNNI

SEQ ID NO: 5204 - protein, 15 aa, Artificial Sequence
  source: /note="Description of Artificial Sequence: Synthetic Linker"
EGMGPVLAPVTPVPV

SEQ ID NO: 5205 - protein, 7 aa, Artificial Sequence
  source: /note="Description of Artificial Sequence: Synthetic Linker"
MLNQNWH

SEQ ID NO: 5206 - protein, 10 aa, Artificial Sequence
  source: /note="Description of Artificial Sequence: Synthetic Linker"
NMTNATDASP

SEQ ID NO: 5207 - protein, 14 aa, Artificial Sequence
  source: /note="Description of Artificial Sequence: Synthetic Linker"
LLYDERTTNLTLDE

SEQ ID NO: 5208 - protein, 6 aa, Artificial Sequence
  source: /note="Description of Artificial Sequence: Synthetic Linker"
EAGYPG

SEQ ID NO: 5209 - protein, 7 aa, Artificial Sequence
  source: /note="Description of Artificial Sequence: Synthetic Linker"
LFDSLSP

SEQ ID NO: 5210 - protein, 7 aa, Artificial Sequence
  source: /note="Description of Artificial Sequence: Synthetic Linker"
TREGKST

SEQ ID NO: 5211 - protein, 5 aa, Artificial Sequence
  source: /note="Description of Artificial Sequence: Synthetic Linker"
AEGDM

SEQ ID NO: 5212 - protein, 6 aa, Artificial Sequence
  source: /note="Description of Artificial Sequence: Synthetic Linker"
AALDKK

SEQ ID NO: 5213 - protein, 6 aa, Artificial Sequence
  source: /note="Description of Artificial Sequence: Synthetic Linker"
ENEGLE

SEQ ID NO: 5214 - protein, 7 aa, Artificial Sequence
  source: /note="Description of Artificial Sequence: Synthetic Linker"
RFRPLRD

SEQ ID NO: 5215 - protein, 7 aa, Artificial Sequence
  source: /note="Description of Artificial Sequence: Synthetic Linker"
VASRARP

SEQ ID NO: 5216 - protein, 4 aa, Artificial Sequence
  source: /note="Description of Artificial Sequence: Synthetic Linker"
TKNI

SEQ ID NO: 5217 - protein, 6 aa, Artificial Sequence
  source: /note="Description of Artificial Sequence: Synthetic Linker"
VSAGST

SEQ ID NO: 5218 - protein, 9 aa, Artificial Sequence
  source: /note="Description of Artificial Sequence: Synthetic Linker"
SGSVKTGTT

SEQ ID NO: 5219 - protein, 10 aa, Artificial Sequence
  source: /note="Description of Artificial Sequence: Synthetic Linker"
DLDIKGYVAA

SEQ ID NO: 5220 - protein, 13 aa, Artificial Sequence
  source: /note="Description of Artificial Sequence: Synthetic Linker"
SRSGTPSTSIDTS

SEQ ID NO: 5221 - protein, 9 aa, Artificial Sequence
  source: /note="Description of Artificial Sequence: Synthetic Linker"
CDGDEYKPV

SEQ ID NO: 5222 - protein, 14 aa, Artificial Sequence
  source: /note="Description of Artificial Sequence: Synthetic Linker"
DGPCEPDEDEDVCQ

SEQ ID NO: 5223 - protein, 14 aa, Artificial Sequence
  source: /note="Description of Artificial Sequence: Synthetic Linker"
RAVLSSTRMGGHFV

SEQ ID NO: 5224 - protein, 4 aa, Artificial Sequence
  source: /note="Description of Artificial Sequence: Synthetic Linker"
QLRT

SEQ ID NO: 5225 - protein, 5 aa, Artificial Sequence
  source: /note="Description of Artificial Sequence: Synthetic Linker"
DITNA

SEQ ID NO: 5226 - protein, 6 aa, Artificial Sequence
  source: /note="Description of Artificial Sequence: Synthetic Linker"
QEVVAP

SEQ ID NO: 5227 - protein, 4 aa, Artificial Sequence
  source: /note="Description of Artificial Sequence: Synthetic Linker"
ILGE

SEQ ID NO: 5228 - protein, 5 aa, Artificial Sequence
  source: /note="Description of Artificial Sequence: Synthetic Linker"
SQGGK

SEQ ID NO: 5229 - protein, 6 aa, Artificial Sequence
  source: /note="Description of Artificial Sequence: Synthetic Linker"
IARPPA

SEQ ID NO: 5230 - protein, 7 aa, Artificial Sequence
  source: /note="Description of Artificial Sequence: Synthetic Linker"
PTFAVER

SEQ ID NO: 5231 - protein, 12 aa, Artificial Sequence
  source: /note="Description of Artificial Sequence: Synthetic Linker"
EGTYGDRPHRPY

SEQ ID NO: 5232 - protein, 24 aa, Artificial Sequence
  source: /note="Description of Artificial Sequence: Synthetic Linker"
YSGDLGNREKDVLPDPSLPPLADL

SEQ ID NO: 5233 - protein, 4 aa, Artificial Sequence
  source: /note="Description of Artificial Sequence: Synthetic Linker"
DYTE

SEQ ID NO: 5234 - protein, 4 aa, Artificial Sequence
  source: /note="Description of Artificial Sequence: Synthetic Linker"
TFSY

SEQ ID NO: 5235 - protein, 6 aa, Artificial Sequence
  source: /note="Description of Artificial Sequence: Synthetic Linker"
DTFIDH

SEQ ID NO: 5236 - protein, 8 aa, Artificial Sequence
  source: /note="Description of Artificial Sequence: Synthetic Linker"
EMGKYDNH

SEQ ID NO: 5237 - protein, 9 aa, Artificial Sequence
  source: /note="Description of Artificial Sequence: Synthetic Linker"
YGQFEPPAL

SEQ ID NO: 5238 - protein, 16 aa, Artificial Sequence
  source: /note="Description of Artificial Sequence: Synthetic Linker"
KYLVQNRVTGEIYESA

SEQ ID NO: 5239 - protein, 13 aa, Artificial Sequence
  source: /note="Description of Artificial Sequence: Synthetic Linker"
DLSVFPELEEGDY

SEQ ID NO: 5240 - protein, 9 aa, Artificial Sequence
  source: /note="Description of Artificial Sequence: Synthetic Linker"
DYGFIEPNE

SEQ ID NO: 5241 - protein, 6 aa, Artificial Sequence
  source: /note="Description of Artificial Sequence: Synthetic Linker"
KSGEDI

SEQ ID NO: 5242 - protein, 29 aa, Artificial Sequence
  source: /note="Description of Artificial Sequence: Synthetic Linker"
INQGEDSVPAKKFKAAPAEISDGEDRSKC

SEQ ID NO: 5243 - protein, 5 aa, Artificial Sequence
  source: /note="Description of Artificial Sequence: Synthetic Linker"
RSPEW

SEQ ID NO: 5244 - protein, 19 aa, Artificial Sequence
  source: /note="Description of Artificial Sequence: Synthetic Linker"
SAFGIRPPLRLGEFTMPEH

SEQ ID NO: 5245 - protein, 12 aa, Artificial Sequence
  source: /note="Description of Artificial Sequence: Synthetic Linker"
LNTGASDNFTRW

SEQ ID NO: 5246 - protein, 12 aa, Artificial Sequence
  source: /note="Description of Artificial Sequence: Synthetic Linker"
AEKGEDIEIKKV

SEQ ID NO: 5247 - protein, 15 aa, Artificial Sequence
  source: /note="Description of Artificial Sequence: Synthetic Linker"
VDRADPLEQGAGDQG

SEQ ID NO: 5248 - protein, 4 aa, Artificial Sequence
  source: /note="Description of Artificial Sequence: Synthetic Linker"
DGDF

SEQ ID NO: 5249 - protein, 4 aa, Artificial Sequence
  source: /note="Description of Artificial Sequence: Synthetic Linker"
KNDK

SEQ ID NO: 5250 - protein, 4 aa, Artificial Sequence
  source: /note="Description of Artificial Sequence: Synthetic Linker"
PIRS

SEQ ID NO: 5251 - protein, 4 aa, Artificial Sequence
  source: /note="Description of Artificial Sequence: Synthetic Linker"
PMTG

SEQ ID NO: 5252 - protein, 4 aa, Artificial Sequence
  source: /note="Description of Artificial Sequence: Synthetic Linker"
RACC

SEQ ID NO: 5253 - protein, 4 aa, Artificial Sequence
  source: /note="Description of Artificial Sequence: Synthetic Linker"
VGTT

SEQ ID NO: 5254 - protein, 5 aa, Artificial Sequence
  source: /note="Description of Artificial Sequence: Synthetic Linker"
DAGIR

SEQ ID NO: 5255 - protein, 5 aa, Artificial Sequence
  source: /note="Description of Artificial Sequence: Synthetic Linker"
DDLPL

SEQ ID NO: 5256 - protein, 5 aa, Artificial Sequence
  source: /note="Description of Artificial Sequence: Synthetic Linker"
GCTSV

SEQ ID NO: 5257 - protein, 5 aa, Artificial Sequence
  source: /note="Description of Artificial Sequence: Synthetic Linker"
ITAFV

SEQ ID NO: 5258 - protein, 5 aa, Artificial Sequence
  source: /note="Description of Artificial Sequence: Synthetic Linker"
TASEM

SEQ ID NO: 5259 - protein, 5 aa, Artificial Sequence
  source: /note="Description of Artificial Sequence: Synthetic Linker"
TGDNK

SEQ ID NO: 5260 - protein, 5 aa, Artificial Sequence
  source: /note="Description of Artificial Sequence: Synthetic Linker"
YETDL

SEQ ID NO: 5261 - protein, 6 aa, Artificial Sequence
  source: /note="Description of Artificial Sequence: Synthetic Linker"
LADDNF

SEQ ID NO: 5262 - protein, 6 aa, Artificial Sequence
  source: /note="Description of Artificial Sequence: Synthetic Linker"
MGSGTA

SEQ ID NO: 5263 - protein, 7 aa, Artificial Sequence
  source: /note="Description of Artificial Sequence: Synthetic Linker"
ARVEPSH

SEQ ID NO: 5264 - protein, 7 aa, Artificial Sequence
  source: /note="Description of Artificial Sequence: Synthetic Linker"
EMVLDDS

SEQ ID NO: 5265 - protein, 7 aa, Artificial Sequence
  source: /note="Description of Artificial Sequence: Synthetic Linker"
RDTPPKR

SEQ ID NO: 5266 - protein, 7 aa, Artificial Sequence
  source: /note="Description of Artificial Sequence: Synthetic Linker"
TGRDTLR

SEQ ID NO: 5267 - protein, 8 aa, Artificial Sequence
  source: /note="Description of Artificial Sequence: Synthetic Linker"
LDPPRKEV

SEQ ID NO: 5268 - protein, 9 aa, Artificial Sequence
  source: /note="Description of Artificial Sequence: Synthetic Linker"
LAWFEEGEE

SEQ ID NO: 5269 - protein, 10 aa, Artificial Sequence
  source: /note="Description of Artificial Sequence: Synthetic Linker"
ALGLPEALIP

SEQ ID NO: 5270 - protein, 12 aa, Artificial Sequence
  source: /note="Description of Artificial Sequence: Synthetic Linker"
DKTGTLTTNQMS

SEQ ID NO: 5271 - protein, 12 aa, Artificial Sequence
  source: /note="Description of Artificial Sequence: Synthetic Linker"
ITGSTYAPEGEV

SEQ ID NO: 5272 - protein, 14 aa, Artificial Sequence
  source: /note="Description of Artificial Sequence: Synthetic Linker"
IGIFGENEEVADRA

SEQ ID NO: 5273 - protein, 6 aa, Artificial Sequence
  source: /note="Description of Artificial Sequence: Synthetic Linker"
YLRQDL

SEQ ID NO: 5274 - protein, 8 aa, Artificial Sequence
  source: /note="Description of Artificial Sequence: Synthetic Linker"
ESQSLSIQ

SEQ ID NO: 5275 - protein, 6 aa, Artificial Sequence
  source: /note="Description of Artificial Sequence: Synthetic Linker"
SGKQSY

SEQ ID NO: 5276 - protein, 14 aa, Artificial Sequence
  source: /note="Description of Artificial Sequence: Synthetic Linker"
FRARGKAVSTVFDQ

SEQ ID NO: 5277 - protein, 6 aa, Artificial Sequence
  source: /note="Description of Artificial Sequence: Synthetic Linker"
DANSEM

SEQ ID NO: 5278 - protein, 7 aa, Artificial Sequence
  source: /note="Description of Artificial Sequence: Synthetic Linker"
DITAQKE

SEQ ID NO: 5279 - protein, 8 aa, Artificial Sequence
  source: /note="Description of Artificial Sequence: Synthetic Linker"
TVESTGKV

SEQ ID NO: 5280 - protein, 5 aa, Artificial Sequence
  source: /note="Description of Artificial Sequence: Synthetic Linker"
AQDRK

SEQ ID NO: 5281 - protein, 8 aa, Artificial Sequence
  source: /note="Description of Artificial Sequence: Synthetic Linker"
ALSSTGEI

SEQ ID NO: 5282 - protein, 17 aa, Artificial Sequence
  source: /note="Description of Artificial Sequence: Synthetic Linker"
LLQVPLPPWPGAPVGGE

SEQ ID NO: 5283 - protein, 6 aa, Artificial Sequence
  source: /note="Description of Artificial Sequence: Synthetic Linker"
FRGPDR

SEQ ID NO: 5284 - protein, 4 aa, Artificial Sequence
  source: /note="Description of Artificial Sequence: Synthetic Linker"
EGGK

SEQ ID NO: 5285 - protein, 6 aa, Artificial Sequence
  source: /note="Description of Artificial Sequence: Synthetic Linker"
INDKYE

SEQ ID NO: 5286 - protein, 6 aa, Artificial Sequence
  source: /note="Description of Artificial Sequence: Synthetic Linker"
NETTNK

SEQ ID NO: 5287 - protein, 8 aa, Artificial Sequence
  source: /note="Description of Artificial Sequence: Synthetic Linker"
DFDSGSLR

SEQ ID NO: 5288 - protein, 9 aa, Artificial Sequence
  source: /note="Description of Artificial Sequence: Synthetic Linker"
KNGDNDFRY

SEQ ID NO: 5289 - protein, 11 aa, Artificial Sequence
  source: /note="Description of Artificial Sequence: Synthetic Linker"
PMNVFYKDSLF

SEQ ID NO: 5290 - protein, 4 aa, Artificial Sequence
  source: /note="Description of Artificial Sequence: Synthetic Linker"
GGEA

SEQ ID NO: 5291 - protein, 4 aa, Artificial Sequence
  source: /note="Description of Artificial Sequence: Synthetic Linker"
LGDV

SEQ ID NO: 5292 - protein, 5 aa, Artificial Sequence
  source: /note="Description of Artificial Sequence: Synthetic Linker"
YSNVE

SEQ ID NO: 5293 - protein, 6 aa, Artificial Sequence
  source: /note="Description of Artificial Sequence: Synthetic Linker"
DPVSKE

SEQ ID NO: 5294 - protein, 6 aa, Artificial Sequence
  source: /note="Description of Artificial Sequence: Synthetic Linker"
GLPGDK

SEQ ID NO: 5295 - protein, 6 aa, Artificial Sequence
  source: /note="Description of Artificial Sequence: Synthetic Linker"
IVPPGQ

SEQ ID NO: 5296 - protein, 9 aa, Artificial Sequence
  source: /note="Description of Artificial Sequence: Synthetic Linker"
TVPIAQDQV

SEQ ID NO: 5297 - protein, 11 aa, Artificial Sequence
  source: /note="Description of Artificial Sequence: Synthetic Linker"
EVPKNETKENG

SEQ ID NO: 5298 - protein, 12 aa, Artificial Sequence
  source: /note="Description of Artificial Sequence: Synthetic Linker"
MYYQQPGQQLAT

SEQ ID NO: 5299 - protein, 16 aa, Artificial Sequence
  source: /note="Description of Artificial Sequence: Synthetic Linker"
QPGCSSGQACENALPV

SEQ ID NO: 5300 - protein, 8 aa, Artificial Sequence
  source: /note="Description of Artificial Sequence: Synthetic Linker"
KYTYEHDP

SEQ ID NO: 5301 - protein, 10 aa, Artificial Sequence
  source: /note="Description of Artificial Sequence: Synthetic Linker"
IGGPPNACLD

SEQ ID NO: 5302 - protein, 20 aa, Artificial Sequence
  source: /note="Description of Artificial Sequence: Synthetic Linker"
ENAQRFNQAQSGNIQSTVML

SEQ ID NO: 5303 - protein, 25 aa, Artificial Sequence
  source: /note="Description of Artificial Sequence: Synthetic Linker"
LQNREHETNGVAKSDQKQEQLLLKK

SEQ ID NO: 5304 - protein, 9 aa, Artificial Sequence
  source: /note="Description of Artificial Sequence: Synthetic Linker"
CEMGSTFQL

SEQ ID NO: 5305 - protein, 26 aa, Artificial Sequence
  source: /note="Description of Artificial Sequence: Synthetic Linker"
PDGRNQNPDLTGLCEPTPQDHIKVTQ

SEQ ID NO: 5306 - protein, 4 aa, Artificial Sequence
  source: /note="Description of Artificial Sequence: Synthetic Linker"
NHPA

SEQ ID NO: 5307 - protein, 5 aa, Artificial Sequence
  source: /note="Description of Artificial Sequence: Synthetic Linker"
CNLTP

SEQ ID NO: 5308 - protein, 5 aa, Artificial Sequence
  source: /note="Description of Artificial Sequence: Synthetic Linker"
IRRTS

SEQ ID NO: 5309 - protein, 6 aa, Artificial Sequence
  source: /note="Description of Artificial Sequence: Synthetic Linker"
KYLPVK

SEQ ID NO: 5310 - protein, 7 aa, Artificial Sequence
  source: /note="Description of Artificial Sequence: Synthetic Linker"
ISGTPIQ

SEQ ID NO: 5311 - protein, 8 aa, Artificial Sequence
  source: /note="Description of Artificial Sequence: Synthetic Linker"
RDADASDK

SEQ ID NO: 5312 - protein, 9 aa, Artificial Sequence
  source: /note="Description of Artificial Sequence: Synthetic Linker"
TGEEGFDGA

SEQ ID NO: 5313 - protein, 10 aa, Artificial Sequence
  source: /note="Description of Artificial Sequence: Synthetic Linker"
ESLQTGKISV

SEQ ID NO: 5314 - protein, 14 aa, Artificial Sequence
  source: /note="Description of Artificial Sequence: Synthetic Linker"
DLFPQNYSTKAVEP

SEQ ID NO: 5315 - protein, 4 aa, Artificial Sequence
  source: /note="Description of Artificial Sequence: Synthetic Linker"
SATH

SEQ ID NO: 5316 - protein, 7 aa, Artificial Sequence
  source: /note="Description of Artificial Sequence: Synthetic Linker"
YIPLPEP

SEQ ID NO: 5317 - protein, 8 aa, Artificial Sequence
  source: /note="Description of Artificial Sequence: Synthetic Linker"
RKTDGYSG

SEQ ID NO: 5318 - protein, 9 aa, Artificial Sequence
  source: /note="Description of Artificial Sequence: Synthetic Linker"
PSRADPNHL

SEQ ID NO: 5319 - protein, 10 aa, Artificial Sequence
  source: /note="Description of Artificial Sequence: Synthetic Linker"
LGTTQNSLTE

SEQ ID NO: 5320 - protein, 9 aa, Artificial Sequence
  source: /note="Description of Artificial Sequence: Synthetic Linker"
NLLGQQPLV

SEQ ID NO: 5321 - protein, 10 aa, Artificial Sequence
  source: /note="Description of Artificial Sequence: Synthetic Linker"
SSYGPASGPL

SEQ ID NO: 5322 - protein, 11 aa, Artificial Sequence
  source: /note="Description of Artificial Sequence: Synthetic Linker"
VAQLPKKQVYI

SEQ ID NO: 5323 - protein, 16 aa, Artificial Sequence
  source: /note="Description of Artificial Sequence: Synthetic Linker"
SATPQGQTAKIEVPHT

SEQ ID NO: 5324 - protein, 4 aa, Artificial Sequence
  source: /note="Description of Artificial Sequence: Synthetic Linker"
FSCS

SEQ ID NO: 5325 - protein, 8 aa, Artificial Sequence
  source: /note="Description of Artificial Sequence: Synthetic Linker"
FWLAIDMS

SEQ ID NO: 5326 - protein, 9 aa, Artificial Sequence
  source: /note="Description of Artificial Sequence: Synthetic Linker"
VKAAPQAPV

SEQ ID NO: 5327 - protein, 13 aa, Artificial Sequence
  source: /note="Description of Artificial Sequence: Synthetic Linker"
ADQSESQMIPKDS

SEQ ID NO: 5328 - protein, 4 aa, Artificial Sequence
  source: /note="Description of Artificial Sequence: Synthetic Linker"
FAFI

SEQ ID NO: 5329 - protein, 4 aa, Artificial Sequence
  source: /note="Description of Artificial Sequence: Synthetic Linker"
IQNT

SEQ ID NO: 5330 - protein, 5 aa, Artificial Sequence
  source: /note="Description of Artificial Sequence: Synthetic Linker"
GTLSP

SEQ ID NO: 5331 - protein, 6 aa, Artificial Sequence
  source: /note="Description of Artificial Sequence: Synthetic Linker"
QVPQDD

SEQ ID NO: 5332 - protein, 8 aa, Artificial Sequence
  source: /note="Description of Artificial Sequence: Synthetic Linker"
HLSAGCPH

SEQ ID NO: 5333 - protein, 11 aa, Artificial Sequence
  source: /note="Description of Artificial Sequence: Synthetic Linker"
FSTRVLPAQAT

SEQ ID NO: 5334 - protein, 4 aa, Artificial Sequence
  source: /note="Description of Artificial Sequence: Synthetic Linker"
EMDS

SEQ ID NO: 5335 - protein, 5 aa, Artificial Sequence
  source: /note="Description of Artificial Sequence: Synthetic Linker"
HFPLK

SEQ ID NO: 5336 - protein, 6 aa, Artificial Sequence
  source: /note="Description of Artificial Sequence: Synthetic Linker"
DLDNVT

SEQ ID NO: 5337 - protein, 6 aa, Artificial Sequence
  source: /note="Description of Artificial Sequence: Synthetic Linker"
FDGQLE

SEQ ID NO: 5338 - protein, 7 aa, Artificial Sequence
  source: /note="Description of Artificial Sequence: Synthetic Linker"
ITNECQW

SEQ ID NO: 5339 - protein, 7 aa, Artificial Sequence
  source: /note="Description of Artificial Sequence: Synthetic Linker"
SQPFPVV

SEQ ID NO: 5340 - protein, 7 aa, Artificial Sequence
  source: /note="Description of Artificial Sequence: Synthetic Linker"
TGARSNF

SEQ ID NO: 5341 - protein, 8 aa, Artificial Sequence
  source: /note="Description of Artificial Sequence: Synthetic Linker"
ESDASNPF

SEQ ID NO: 5342 - protein, 8 aa, Artificial Sequence
  source: /note="Description of Artificial Sequence: Synthetic Linker"
HFFGNRSI

SEQ ID NO: 5343 - protein, 9 aa, Artificial Sequence
  source: /note="Description of Artificial Sequence: Synthetic Linker"
QPIYPATLT

SEQ ID NO: 5344 - protein, 10 aa, Artificial Sequence
  source: /note="Description of Artificial Sequence: Synthetic Linker"
FLAGTRKCSV

SEQ ID NO: 5345 - protein, 12 aa, Artificial Sequence
  source: /note="Description of Artificial Sequence: Synthetic Linker"
LNPQHSAPKPNV

SEQ ID NO: 5346 - protein, 12 aa, Artificial Sequence
  source: /note="Description of Artificial Sequence: Synthetic Linker"
SKGKQLGENQLV

SEQ ID NO: 5347 - protein, 15 aa, Artificial Sequence
  source: /note="Description of Artificial Sequence: Synthetic Linker"
ATKQDPVRPKRPLSS

SEQ ID NO: 5348 - protein, 16 aa, Artificial Sequence
  source: /note="Description of Artificial Sequence: Synthetic Linker"
ICDSHPTNKNNPTTPL

SEQ ID NO: 5349 - protein, 9 aa, Artificial Sequence
  source: /note="Description of Artificial Sequence: Synthetic Linker"
YLDTKPAPV

SEQ ID NO: 5350 - protein, 4 aa, Artificial Sequence
  source: /note="Description of Artificial Sequence: Synthetic Linker"
IHKK

SEQ ID NO: 5351 - protein, 5 aa, Artificial Sequence
  source: /note="Description of Artificial Sequence: Synthetic Linker"
GIMPG

SEQ ID NO: 5352 - protein, 5 aa, Artificial Sequence
  source: /note="Description of Artificial Sequence: Synthetic Linker"
NPGEC

SEQ ID NO: 5353 - protein, 7 aa, Artificial Sequence
  source: /note="Description of Artificial Sequence: Synthetic Linker"
IGPNCPG

SEQ ID NO: 5354 - protein, 8 aa, Artificial Sequence
  source: /note="Description of Artificial Sequence: Synthetic Linker"
CITEGIPQ

SEQ ID NO: 5355 - protein, 8 aa, Artificial Sequence
  source: /note="Description of Artificial Sequence: Synthetic Linker"
LLRQGKTR

SEQ ID NO: 5356 - protein, 4 aa, Artificial Sequence
  source: /note="Description of Artificial Sequence: Synthetic Linker"
MRDQ

SEQ ID NO: 5357 - protein, 4 aa, Artificial Sequence
  source: /note="Description of Artificial Sequence: Synthetic Linker"
QEDP

SEQ ID NO: 5358 - protein, 5 aa, Artificial Sequence
  source: /note="Description of Artificial Sequence: Synthetic Linker"
CLDGK

SEQ ID NO: 5359 - protein, 5 aa, Artificial Sequence
  source: /note="Description of Artificial Sequence: Synthetic Linker"
QWELN

SEQ ID NO: 5360 - protein, 6 aa, Artificial Sequence
  source: /note="Description of Artificial Sequence: Synthetic Linker"
ALDGNI

SEQ ID NO: 5361 - protein, 6 aa, Artificial Sequence
  source: /note="Description of Artificial Sequence: Synthetic Linker"
TKQGDL

SEQ ID NO: 5362 - protein, 31 aa, Artificial Sequence
  source: /note="Description of Artificial Sequence: Synthetic Linker"
KGEKYEKRIERLSVRKEEDVKTRSGKLGDNV

SEQ ID NO: 5363 - protein, 27 aa, Artificial Sequence
  source: /note="Description of Artificial Sequence: Synthetic Linker"
AEDRPLSRELPAPAGGPVALSLHDEPT

SEQ ID NO: 5364 - protein, 9 aa, Artificial Sequence
  source: /note="Description of Artificial Sequence: Synthetic Linker"
PYQKTSIPK

SEQ ID NO: 5365 - protein, 9 aa, Artificial Sequence
  source: /note="Description of Artificial Sequence: Synthetic Linker"
RGAGKPNSS

SEQ ID NO: 5366 - protein, 6 aa, Artificial Sequence
  source: /note="Description of Artificial Sequence: Synthetic Linker"
AVGKNP

SEQ ID NO: 5367 - protein, 6 aa, Artificial Sequence
  source: /note="Description of Artificial Sequence: Synthetic Linker"
DTATNT

SEQ ID NO: 5368 - protein, 6 aa, Artificial Sequence
  source: /note="Description of Artificial Sequence: Synthetic Linker"
FLSEPV

SEQ ID NO: 5369 - protein, 6 aa, Artificial Sequence
  source: /note="Description of Artificial Sequence: Synthetic Linker"
LSFCNT

SEQ ID NO: 5370 - protein, 7 aa, Artificial Sequence
  source: /note="Description of Artificial Sequence: Synthetic Linker"
SNITSGY

SEQ ID NO: 5371 - protein, 7 aa, Artificial Sequence
  source: /note="Description of Artificial Sequence: Synthetic Linker"
VTPDGKK

SEQ ID NO: 5372 - protein, 7 aa, Artificial Sequence
  source: /note="Description of Artificial Sequence: Synthetic Linker"
YASGQFI

SEQ ID NO: 5373 - protein, 13 aa, Artificial Sequence
  source: /note="Description of Artificial Sequence: Synthetic Linker"
SIPVQPVYPSADF

SEQ ID NO: 5374 - protein, 7 aa, Artificial Sequence
  source: /note="Description of Artificial Sequence: Synthetic Linker"
EIPTSNI

SEQ ID NO: 5375 - protein, 8 aa, Artificial Sequence
  source: /note="Description of Artificial Sequence: Synthetic Linker"
KADFPTPS

SEQ ID NO: 5376 - protein, 10 aa, Artificial Sequence
  source: /note="Description of Artificial Sequence: Synthetic Linker"
HPYIQNPDPA

SEQ ID NO: 5377 - protein, 11 aa, Artificial Sequence
  source: /note="Description of Artificial Sequence: Synthetic Linker"
DTPPNFLDDDM

SEQ ID NO: 5378 - protein, 7 aa, Artificial Sequence
  source: /note="Description of Artificial Sequence: Synthetic Linker"
FCKALNP

SEQ ID NO: 5379 - protein, 13 aa, Artificial Sequence
  source: /note="Description of Artificial Sequence: Synthetic Linker"
HHDYSLPAAGESW

SEQ ID NO: 5380 - protein, 4 aa, Artificial Sequence
  source: /note="Description of Artificial Sequence: Synthetic Linker"
AEGV

SEQ ID NO: 5381 - protein, 7 aa, Artificial Sequence
  source: /note="Description of Artificial Sequence: Synthetic Linker"
LMLIADV

SEQ ID NO: 5382 - protein, 8 aa, Artificial Sequence
  source: /note="Description of Artificial Sequence: Synthetic Linker"
EAGEEGEK

SEQ ID NO: 5383 - protein, 22 aa, Artificial Sequence
  source: /note="Description of Artificial Sequence: Synthetic Linker"
RSTPPPEMPKPVPRKEVQAGVE

SEQ ID NO: 5384 - protein, 6 aa, Artificial Sequence
  source: /note="Description of Artificial Sequence: Synthetic Linker"
CVPLVR

SEQ ID NO: 5385 - protein, 6 aa, Artificial Sequence
  source: /note="Description of Artificial Sequence: Synthetic Linker"
KSDPIQ

SEQ ID NO: 5386 - protein, 4 aa, Artificial Sequence
  source: /note="Description of Artificial Sequence: Synthetic Linker"
AGVE

SEQ ID NO: 5387 - protein, 12 aa, Artificial Sequence
  source: /note="Description of Artificial Sequence: Synthetic Linker"
NAGGELFRDVNV

SEQ ID NO: 5388 - protein, 17 aa, Artificial Sequence
  source: /note="Description of Artificial Sequence: Synthetic Linker"
ERGAWSAPLPRQPRADT

SEQ ID NO: 5389 - protein, 19 aa, Artificial Sequence
  source: /note="Description of Artificial Sequence: Synthetic Linker"
LAGQQLEHGQTRRFGAISQ

SEQ ID NO: 5390 - protein, 4 aa, Artificial Sequence
  source: /note="Description of Artificial Sequence: Synthetic Linker"
IDNG

SEQ ID NO: 5391 - protein, 4 aa, Artificial Sequence
  source: /note="Description of Artificial Sequence: Synthetic Linker"
KVSW

SEQ ID NO: 5392 - protein, 5 aa, Artificial Sequence
  source: /note="Description of Artificial Sequence: Synthetic Linker"
NRGES

SEQ ID NO: 5393 - protein, 6 aa, Artificial Sequence
  source: /note="Description of Artificial Sequence: Synthetic Linker"
ITAKDE

SEQ ID NO: 5394 - protein, 6 aa, Artificial Sequence
  source: /note="Description of Artificial Sequence: Synthetic Linker"
LWPHTK

SEQ ID NO: 5395 - protein, 6 aa, Artificial Sequence
  source: /note="Description of Artificial Sequence: Synthetic Linker"
MAIGPV

SEQ ID NO: 5396 - protein, 8 aa, Artificial Sequence
  source: /note="Description of Artificial Sequence: Synthetic Linker"
AEKNYDVI

SEQ ID NO: 5397 - protein, 8 aa, Artificial Sequence
  source: /note="Description of Artificial Sequence: Synthetic Linker"
DLDRTLTQ

SEQ ID NO: 5398 - protein, 9 aa, Artificial Sequence
  source: /note="Description of Artificial Sequence: Synthetic Linker"
NIAHDDKPG

SEQ ID NO: 5399 - protein, 4 aa, Artificial Sequence
  source: /note="Description of Artificial Sequence: Synthetic Linker"
FFDK

SEQ ID NO: 5400 - protein, 6 aa, Artificial Sequence
  source: /note="Description of Artificial Sequence: Synthetic Linker"
LFSNDE

SEQ ID NO: 5401 - protein, 6 aa, Artificial Sequence
  source: /note="Description of Artificial Sequence: Synthetic Linker"
VTPGSE

SEQ ID NO: 5402 - protein, 7 aa, Artificial Sequence
  source: /note="Description of Artificial Sequence: Synthetic Linker"
ERKERDH

SEQ ID NO: 5403 - protein, 12 aa, Artificial Sequence
  source: /note="Description of Artificial Sequence: Synthetic Linker"
FDIDQNISSDDF

SEQ ID NO: 5404 - protein, 17 aa, Artificial Sequence
  source: /note="Description of Artificial Sequence: Synthetic Linker"
ELIDAIPEDENVTLYSQ

SEQ ID NO: 5405 - protein, 19 aa, Artificial Sequence
  source: /note="Description of Artificial Sequence: Synthetic Linker"
TMKQIVNENMKIERKVVSR

SEQ ID NO: 5406 - protein, 23 aa, Artificial Sequence
  source: /note="Description of Artificial Sequence: Synthetic Linker"
AHAIKRLYGNVKFGVGPVIEGGF

SEQ ID NO: 5407 - protein, 21 aa, Artificial Sequence
  source: /note="Description of Artificial Sequence: Synthetic Linker"
INGGWGPWSPWDICSVTCGGG

SEQ ID NO: 5408 - protein, 16 aa, Artificial Sequence
  source: /note="Description of Artificial Sequence: Synthetic Linker"
LKMKGLTYTMCDKTKF

SEQ ID NO: 5409 - protein, 7 aa, Artificial Sequence
  source: /note="Description of Artificial Sequence: Synthetic Linker"
LRGEVVS

SEQ ID NO: 5410 - protein, 10 aa, Artificial Sequence
  source: /note="Description of Artificial Sequence: Synthetic Linker"
IHLPKTLEGM

SEQ ID NO: 5411 - protein, 4 aa, Artificial Sequence
  source: /note="Description of Artificial Sequence: Synthetic Linker"
PYPV

SEQ ID NO: 5412 - protein, 14 aa, Artificial Sequence
  source: /note="Description of Artificial Sequence: Synthetic Linker"
LNKEGEPTKQRTRD

SEQ ID NO: 5413 - protein, 11 aa, Artificial Sequence
  source: /note="Description of Artificial Sequence: Synthetic Linker"
RFRDRLPEKLR

SEQ ID NO: 5414 - protein, 12 aa, Artificial Sequence
  source: /note="Description of Artificial Sequence: Synthetic Linker"
DAPQQDPEGNKT

SEQ ID NO: 5415 - protein, 4 aa, Artificial Sequence
  source: /note="Description of Artificial Sequence: Synthetic Linker"
ELPL

SEQ ID NO: 5416 - protein, 4 aa, Artificial Sequence
  source: /note="Description of Artificial Sequence: Synthetic Linker"
VHGK

SEQ ID NO: 5417 - protein, 5 aa, Artificial Sequence
  source: /note="Description of Artificial Sequence: Synthetic Linker"
TNTEK

SEQ ID NO: 5418 - protein, 9 aa, Artificial Sequence
  source: /note="Description of Artificial Sequence: Synthetic Linker"
DSPLKYWPK

SEQ ID NO: 5419 - protein, 12 aa, Artificial Sequence
  source: /note="Description of Artificial Sequence: Synthetic Linker"
SCSEPRCFNGGT

SEQ ID NO: 5420 - protein, 4 aa, Artificial Sequence
  source: /note="Description of Artificial Sequence: Synthetic Linker"
IDGK

SEQ ID NO: 5421 - protein, 5 aa, Artificial Sequence
  source: /note="Description of Artificial Sequence: Synthetic Linker"
PLEGT

SEQ ID NO: 5422 - protein, 9 aa, Artificial Sequence
  source: /note="Description of Artificial Sequence: Synthetic Linker"
AMPGWQDKV

SEQ ID NO: 5423 - protein, 8 aa, Artificial Sequence
  source: /note="Description of Artificial Sequence: Synthetic Linker"
YKKTARPK

SEQ ID NO: 5424 - protein, 12 aa, Artificial Sequence
  source: /note="Description of Artificial Sequence: Synthetic Linker"
TWAPHPRPLPQA

SEQ ID NO: 5425 - protein, 7 aa, Artificial Sequence
  source: /note="Description of Artificial Sequence: Synthetic Linker"
ELNEEMP

SEQ ID NO: 5426 - protein, 17 aa, Artificial Sequence
  source: /note="Description of Artificial Sequence: Synthetic Linker"
IVDYSPQQEGKVFFGAW

SEQ ID NO: 5427 - protein, 6 aa, Artificial Sequence
  source: /note="Description of Artificial Sequence: Synthetic Linker"
QRVRNR

SEQ ID NO: 5428 - protein, 5 aa, Artificial Sequence
  source: /note="Description of Artificial Sequence: Synthetic Linker"
LFVKP

SEQ ID NO: 5429 - protein, 6 aa, Artificial Sequence
  source: /note="Description of Artificial Sequence: Synthetic Linker"
NLNLTP

SEQ ID NO: 5430 - protein, 18 aa, Artificial Sequence
  source: /note="Description of Artificial Sequence: Synthetic Linker"
YSKKAPPQEEIEFVGEHP

SEQ ID NO: 5431 - protein, 4 aa, Artificial Sequence
  source: /note="Description of Artificial Sequence: Synthetic Linker"
IHSP

SEQ ID NO: 5432 - protein, 4 aa, Artificial Sequence
  source: /note="Description of Artificial Sequence: Synthetic Linker"
LTDS

SEQ ID NO: 5433 - protein, 5 aa, Artificial Sequence
  source: /note="Description of Artificial Sequence: Synthetic Linker"
KDGRL

SEQ ID NO: 5434 - protein, 9 aa, Artificial Sequence
  source: /note="Description of Artificial Sequence: Synthetic Linker"
ARINEREET

SEQ ID NO: 5435 - protein, 19 aa, Artificial Sequence
  source: /note="Description of Artificial Sequence: Synthetic Linker"
LWNCAPPQSEVVYRPLVSL

SEQ ID NO: 5436 - protein, 5 aa, Artificial Sequence
  source: /note="Description of Artificial Sequence: Synthetic Linker"
EFPEV

SEQ ID NO: 5437 - protein, 7 aa, Artificial Sequence
  source: /note="Description of Artificial Sequence: Synthetic Linker"
RTASHSI

SEQ ID NO: 5438 - protein, 21 aa, Artificial Sequence
  source: /note="Description of Artificial Sequence: Synthetic Linker"
EDGVIRRRVALLDPVKVNTKV

SEQ ID NO: 5439 - protein, 9 aa, Artificial Sequence
  source: /note="Description of Artificial Sequence: Synthetic Linker"
VLAGGKSGV

SEQ ID NO: 5440 - protein, 4 aa, Artificial Sequence
  source: /note="Description of Artificial Sequence: Synthetic Linker"
QKHV

SEQ ID NO: 5441 - protein, 5 aa, Artificial Sequence
  source: /note="Description of Artificial Sequence: Synthetic Linker"
VAPLI

SEQ ID NO: 5442 - protein, 6 aa, Artificial Sequence
  source: /note="Description of Artificial Sequence: Synthetic Linker"
AADTGL

SEQ ID NO: 5443 - protein, 6 aa, Artificial Sequence
  source: /note="Description of Artificial Sequence: Synthetic Linker"
FANDPQ

SEQ ID NO: 5444 - protein, 6 aa, Artificial Sequence
  source: /note="Description of Artificial Sequence: Synthetic Linker"
LLDHHQ

SEQ ID NO: 5445 - protein, 9 aa, Artificial Sequence
  source: /note="Description of Artificial Sequence: Synthetic Linker"
SSPHALGVI

SEQ ID NO: 5446 - protein, 11 aa, Artificial Sequence
  source: /note="Description of Artificial Sequence: Synthetic Linker"
SERSFPDDLNM

SEQ ID NO: 5447 - protein, 21 aa, Artificial Sequence
  source: /note="Description of Artificial Sequence: Synthetic Linker"
DMGYLGPDPVARSLRTRRAGA

SEQ ID NO: 5448 - protein, 5 aa, Artificial Sequence
  source: /note="Description of Artificial Sequence: Synthetic Linker"
EMPSL

SEQ ID NO: 5449 - protein, 5 aa, Artificial Sequence
  source: /note="Description of Artificial Sequence: Synthetic Linker"
RREDI

SEQ ID NO: 5450 - protein, 8 aa, Artificial Sequence
  source: /note="Description of Artificial Sequence: Synthetic Linker"
IHYDWPGN

SEQ ID NO: 5451 - protein, 9 aa, Artificial Sequence
  source: /note="Description of Artificial Sequence: Synthetic Linker"
LLTGEYISE

SEQ ID NO: 5452 - protein, 11 aa, Artificial Sequence
  source: /note="Description of Artificial Sequence: Synthetic Linker"
RNRKVVKGFTP

SEQ ID NO: 5453 - protein, 17 aa, Artificial Sequence
  source: /note="Description of Artificial Sequence: Synthetic Linker"
IAATPIKTEYSGEIQPL

SEQ ID NO: 5454 - protein, 4 aa, Artificial Sequence
  source: /note="Description of Artificial Sequence: Synthetic Linker"
NQYR

SEQ ID NO: 5455 - protein, 7 aa, Artificial Sequence
  source: /note="Description of Artificial Sequence: Synthetic Linker"
EMGLSLQ

SEQ ID NO: 5456 - protein, 7 aa, Artificial Sequence
  source: /note="Description of Artificial Sequence: Synthetic Linker"
KDSAQNS

SEQ ID NO: 5457 - protein, 11 aa, Artificial Sequence
  source: /note="Description of Artificial Sequence: Synthetic Linker"
HDVELNLDYEE

SEQ ID NO: 5458 - protein, 5 aa, Artificial Sequence
  source: /note="Description of Artificial Sequence: Synthetic Linker"
PVDAQ

SEQ ID NO: 5459 - protein, 5 aa, Artificial Sequence
  source: /note="Description of Artificial Sequence: Synthetic Linker"
VPIIE

SEQ ID NO: 5460 - protein, 7 aa, Artificial Sequence
  source: /note="Description of Artificial Sequence: Synthetic Linker"
GVFDGGK

SEQ ID NO: 5461 - protein, 4 aa, Artificial Sequence
  source: /note="Description of Artificial Sequence: Synthetic Linker"
YLRE

SEQ ID NO: 5462 - protein, 6 aa, Artificial Sequence
  source: /note="Description of Artificial Sequence: Synthetic Linker"
IEEDSP

SEQ ID NO: 5463 - protein, 5 aa, Artificial Sequence
  source: /note="Description of Artificial Sequence: Synthetic Linker"
RKSFL

SEQ ID NO: 5464 - protein, 7 aa, Artificial Sequence
  source: /note="Description of Artificial Sequence: Synthetic Linker"
DILDDDR

SEQ ID NO: 5465 - protein, 7 aa, Artificial Sequence
  source: /note="Description of Artificial Sequence: Synthetic Linker"
SGKGGDK

SEQ ID NO: 5466 - protein, 15 aa, Artificial Sequence
  source: /note="Description of Artificial Sequence: Synthetic Linker"
MGGTFTDKDPFRSGR

SEQ ID NO: 5467 - protein, 4 aa, Artificial Sequence
  source: /note="Description of Artificial Sequence: Synthetic Linker"
VEER

SEQ ID NO: 5468 - protein, 7 aa, Artificial Sequence
  source: /note="Description of Artificial Sequence: Synthetic Linker"
ELPELTA

SEQ ID NO: 5469 - protein, 11 aa, Artificial Sequence
  source: /note="Description of Artificial Sequence: Synthetic Linker"
IKRFGVEDGSV

SEQ ID NO: 5470 - protein, 4 aa, Artificial Sequence
  source: /note="Description of Artificial Sequence: Synthetic Linker"
AYRW

SEQ ID NO: 5471 - protein, 4 aa, Artificial Sequence
  source: /note="Description of Artificial Sequence: Synthetic Linker"
EDAL

SEQ ID NO: 5472 - protein, 7 aa, Artificial Sequence
  source: /note="Description of Artificial Sequence: Synthetic Linker"
IRTVGEA

SEQ ID NO: 5473 - protein, 15 aa, Artificial Sequence
  source: /note="Description of Artificial Sequence: Synthetic Linker"
ETGLNAYLPGLAGKE

SEQ ID NO: 5474 - protein, 9 aa, Artificial Sequence
  source: /note="Description of Artificial Sequence: Synthetic Linker"
LEGRIKGKE

SEQ ID NO: 5475 - protein, 5 aa, Artificial Sequence
  source: /note="Description of Artificial Sequence: Synthetic Linker"
RMRNF

SEQ ID NO: 5476 - protein, 6 aa, Artificial Sequence
  source: /note="Description of Artificial Sequence: Synthetic Linker"
RGVLPE

SEQ ID NO: 5477 - protein, 6 aa, Artificial Sequence
  source: /note="Description of Artificial Sequence: Synthetic Linker"
SLEEQR

SEQ ID NO: 5478 - protein, 7 aa, Artificial Sequence
  source: /note="Description of Artificial Sequence: Synthetic Linker"
ANQLQNY

SEQ ID NO: 5479 - protein, 7 aa, Artificial Sequence
  source: /note="Description of Artificial Sequence: Synthetic Linker"
NYLLPAG

SEQ ID NO: 5480 - protein, 14 aa, Artificial Sequence
  source: /note="Description of Artificial Sequence: Synthetic Linker"
LDWQPRENPFQNLK

SEQ ID NO: 5481 - protein, 4 aa, Artificial Sequence
  source: /note="Description of Artificial Sequence: Synthetic Linker"
RIQM

SEQ ID NO: 5482 - protein, 4 aa, Artificial Sequence
  source: /note="Description of Artificial Sequence: Synthetic Linker"
WTDP

SEQ ID NO: 5483 - protein, 5 aa, Artificial Sequence
  source: /note="Description of Artificial Sequence: Synthetic Linker"
ELGLL

SEQ ID NO: 5484 - protein, 7 aa, Artificial Sequence
  source: /note="Description of Artificial Sequence: Synthetic Linker"
APSHGQI

SEQ ID NO: 5485 - protein, 8 aa, Artificial Sequence
  source: /note="Description of Artificial Sequence: Synthetic Linker"
ATGMVDER

SEQ ID NO: 5486 - protein, 5 aa, Artificial Sequence
  source: /note="Description of Artificial Sequence: Synthetic Linker"
FSLDE

SEQ ID NO: 5487 - protein, 6 aa, Artificial Sequence
  source: /note="Description of Artificial Sequence: Synthetic Linker"
HWKLEA

SEQ ID NO: 5488 - protein, 4 aa, Artificial Sequence
  source: /note="Description of Artificial Sequence: Synthetic Linker"
SEIG

SEQ ID NO: 5489 - protein, 8 aa, Artificial Sequence
  source: /note="Description of Artificial Sequence: Synthetic Linker"
KGIGHSRF

SEQ ID NO: 5490 - protein, 5 aa, Artificial Sequence
  source: /note="Description of Artificial Sequence: Synthetic Linker"
EGIKD

SEQ ID NO: 5491 - protein, 7 aa, Artificial Sequence
  source: /note="Description of Artificial Sequence: Synthetic Linker"
LSRFPTP

SEQ ID NO: 5492 - protein, 15 aa, Artificial Sequence
  source: /note="Description of Artificial Sequence: Synthetic Linker"
LLSPYHHVSGYSPRY

SEQ ID NO: 5493 - protein, 4 aa, Artificial Sequence
  source: /note="Description of Artificial Sequence: Synthetic Linker"
PGDW

SEQ ID NO: 5494 - protein, 6 aa, Artificial Sequence
  source: /note="Description of Artificial Sequence: Synthetic Linker"
DINKNE

SEQ ID NO: 5495 - protein, 6 aa, Artificial Sequence
  source: /note="Description of Artificial Sequence: Synthetic Linker"
ITPYAE

SEQ ID NO: 5496 - protein, 7 aa, Artificial Sequence
  source: /note="Description of Artificial Sequence: Synthetic Linker"
EFQSIGD

SEQ ID NO: 5497 - protein, 7 aa, Artificial Sequence
  source: /note="Description of Artificial Sequence: Synthetic Linker"
KDPEGNV

SEQ ID NO: 5498 - protein, 7 aa, Artificial Sequence
  source: /note="Description of Artificial Sequence: Synthetic Linker"
SLSVIGE

SEQ ID NO: 5499 - protein, 7 aa, Artificial Sequence
  source: /note="Description of Artificial Sequence: Synthetic Linker"
SPVNSKR

SEQ ID NO: 5500 - protein, 8 aa, Artificial Sequence
  source: /note="Description of Artificial Sequence: Synthetic Linker"
ENTRGFHG

SEQ ID NO: 5501 - protein, 8 aa, Artificial Sequence
  source: /note="Description of Artificial Sequence: Synthetic Linker"
NNLKRDYT

SEQ ID NO: 5502 - protein, 10 aa, Artificial Sequence
  source: /note="Description of Artificial Sequence: Synthetic Linker"
KYEDFRSPSA

SEQ ID NO: 5503 - protein, 24 aa, Artificial Sequence
  source: /note="Description of Artificial Sequence: Synthetic Linker"
YPRLTNKIPKPPQEVKPHPYGVDR

SEQ ID NO: 5504 - protein, 7 aa, Artificial Sequence
  source: /note="Description of Artificial Sequence: Synthetic Linker"
ARDRSYE

SEQ ID NO: 5505 - protein, 13 aa, Artificial Sequence
  source: /note="Description of Artificial Sequence: Synthetic Linker"
VTSTVKNDIYAHI

SEQ ID NO: 5506 - protein, 22 aa, Artificial Sequence
  source: /note="Description of Artificial Sequence: Synthetic Linker"
PYSERYGYRPALIPRPVMAGTL

SEQ ID NO: 5507 - protein, 5 aa, Artificial Sequence
  source: /note="Description of Artificial Sequence: Synthetic Linker"
VSQPG

SEQ ID NO: 5508 - protein, 6 aa, Artificial Sequence
  source: /note="Description of Artificial Sequence: Synthetic Linker"
LEGLPY

SEQ ID NO: 5509 - protein, 4 aa, Artificial Sequence
  source: /note="Description of Artificial Sequence: Synthetic Linker"
QPGV

SEQ ID NO: 5510 - protein, 5 aa, Artificial Sequence
  source: /note="Description of Artificial Sequence: Synthetic Linker"
WKLEG

SEQ ID NO: 5511 - protein, 6 aa, Artificial Sequence
  source: /note="Description of Artificial Sequence: Synthetic Linker"
TAYNAP

SEQ ID NO: 5512 - protein, 11 aa, Artificial Sequence
  source: /note="Description of Artificial Sequence: Synthetic Linker"
HKHDLSETNVY

SEQ ID NO: 5513 - protein, 7 aa, Artificial Sequence
  source: /note="Description of Artificial Sequence: Synthetic Linker"
VLQAVTD

SEQ ID NO: 5514 - protein, 4 aa, Artificial Sequence
  source: /note="Description of Artificial Sequence: Synthetic Linker"
YKDK

SEQ ID NO: 5515 - protein, 6 aa, Artificial Sequence
  source: /note="Description of Artificial Sequence: Synthetic Linker"
NLPFNM

SEQ ID NO: 5516 - protein, 6 aa, Artificial Sequence
  source: /note="Description of Artificial Sequence: Synthetic Linker"
WGVKDP

SEQ ID NO: 5517 - protein, 13 aa, Artificial Sequence
  source: /note="Description of Artificial Sequence: Synthetic Linker"
QKKKYGDKVPENL

SEQ ID NO: 5518 - protein, 14 aa, Artificial Sequence
  source: /note="Description of Artificial Sequence: Synthetic Linker"
NDLVEFNRFTNSPL

SEQ ID NO: 5519 - protein, 10 aa, Artificial Sequence
  source: /note="Description of Artificial Sequence: Synthetic Linker"
LKEQESPVKV

SEQ ID NO: 5520 - protein, 6 aa, Artificial Sequence
  source: /note="Description of Artificial Sequence: Synthetic Linker"
EEGIAN

SEQ ID NO: 5521 - protein, 11 aa, Artificial Sequence
  source: /note="Description of Artificial Sequence: Synthetic Linker"
ADFQGAGRRFD

SEQ ID NO: 5522 - protein, 6 aa, Artificial Sequence
  source: /note="Description of Artificial Sequence: Synthetic Linker"
AAGLPR

SEQ ID NO: 5523 - protein, 10 aa, Artificial Sequence
  source: /note="Description of Artificial Sequence: Synthetic Linker"
TFTGLPHRFE

SEQ ID NO: 5524 - protein, 4 aa, Artificial Sequence
  source: /note="Description of Artificial Sequence: Synthetic Linker"
TTVD

SEQ ID NO: 5525 - protein, 4 aa, Artificial Sequence
  source: /note="Description of Artificial Sequence: Synthetic Linker"
DNLR

SEQ ID NO: 5526 - protein, 5 aa, Artificial Sequence
  source: /note="Description of Artificial Sequence: Synthetic Linker"
FYHEP

SEQ ID NO: 5527 - protein, 6 aa, Artificial Sequence
  source: /note="Description of Artificial Sequence: Synthetic Linker"
ALGYPL

SEQ ID NO: 5528 - protein, 6 aa, Artificial Sequence
  source: /note="Description of Artificial Sequence: Synthetic Linker"
LLGEIS

SEQ ID NO: 5529 - protein, 6 aa, Artificial Sequence
  source: /note="Description of Artificial Sequence: Synthetic Linker"
MGTVGN

SEQ ID NO: 5530 - protein, 6 aa, Artificial Sequence
  source: /note="Description of Artificial Sequence: Synthetic Linker"
TGTNGK

SEQ ID NO: 5531 - protein, 10 aa, Artificial Sequence
  source: /note="Description of Artificial Sequence: Synthetic Linker"
RLQPVCGRME

SEQ ID NO: 5532 - protein, 12 aa, Artificial Sequence
  source: /note="Description of Artificial Sequence: Synthetic Linker"
TSEAHEKPEEKR

SEQ ID NO: 5533 - protein, 16 aa, Artificial Sequence
  source: /note="Description of Artificial Sequence: Synthetic Linker"
NFGGYFPNKLAEYHDF

SEQ ID NO: 5534 - protein, 15 aa, Artificial Sequence
  source: /note="Description of Artificial Sequence: Synthetic Linker"
RFAPPTWERIYPLDL

SEQ ID NO: 5535 - protein, 4 aa, Artificial Sequence
  source: /note="Description of Artificial Sequence: Synthetic Linker"
VFQP

SEQ ID NO: 5536 - protein, 13 aa, Artificial Sequence
  source: /note="Description of Artificial Sequence: Synthetic Linker"
EKASPAFYPQGQE

SEQ ID NO: 5537 - protein, 35 aa, Artificial Sequence
  source: /note="Description of Artificial Sequence: Synthetic Linker"
SMAVRFAKVPPDAAKAFIADRSMLFNGGTASRPPV

SEQ ID NO: 5538 - protein, 4 aa, Artificial Sequence
  source: /note="Description of Artificial Sequence: Synthetic Linker"
VLKL

SEQ ID NO: 5539 - protein, 6 aa, Artificial Sequence
  source: /note="Description of Artificial Sequence: Synthetic Linker"
DLKNSK

SEQ ID NO: 5540 - protein, 9 aa, Artificial Sequence
  source: /note="Description of Artificial Sequence: Synthetic Linker"
LKKDFQGVE

SEQ ID NO: 5541 - protein, 4 aa, Artificial Sequence
  source: /note="Description of Artificial Sequence: Synthetic Linker"
GYTG

SEQ ID NO: 5542 - protein, 4 aa, Artificial Sequence
  source: /note="Description of Artificial Sequence: Synthetic Linker"
PMSD

SEQ ID NO: 5543 - protein, 4 aa, Artificial Sequence
  source: /note="Description of Artificial Sequence: Synthetic Linker"
SDPE

SEQ ID NO: 5544 - protein, 5 aa, Artificial Sequence
  source: /note="Description of Artificial Sequence: Synthetic Linker"
DAPGQ

SEQ ID NO: 5545 - protein, 5 aa, Artificial Sequence
  source: /note="Description of Artificial Sequence: Synthetic Linker"
FEQTL

SEQ ID NO: 5546 - protein, 5 aa, Artificial Sequence
  source: /note="Description of Artificial Sequence: Synthetic Linker"
GGLSQ

SEQ ID NO: 5547 - protein, 6 aa, Artificial Sequence
  source: /note="Description of Artificial Sequence: Synthetic Linker"
AGENEI

SEQ ID NO: 5548 - protein, 6 aa, Artificial Sequence
  source: /note="Description of Artificial Sequence: Synthetic Linker"
QRCGFV

SEQ ID NO: 5549 - protein, 6 aa, Artificial Sequence
  source: /note="Description of Artificial Sequence: Synthetic Linker"
RQREGT

SEQ ID NO: 5550 - protein, 7 aa, Artificial Sequence
  source: /note="Description of Artificial Sequence: Synthetic Linker"
HGNNPLA

SEQ ID NO: 5551 - protein, 8 aa, Artificial Sequence
  source: /note="Description of Artificial Sequence: Synthetic Linker"
GAHYRTSP

SEQ ID NO: 5552 - protein, 8 aa, Artificial Sequence
  source: /note="Description of Artificial Sequence: Synthetic Linker"
QYTQDLDY

SEQ ID NO: 5553 - protein, 11 aa, Artificial Sequence
  source: /note="Description of Artificial Sequence: Synthetic Linker"
WAGFRRPRGNL

SEQ ID NO: 5554 - protein, 13 aa, Artificial Sequence
  source: /note="Description of Artificial Sequence: Synthetic Linker"
MGNHREASSGCYT

SEQ ID NO: 5555 - protein, 17 aa, Artificial Sequence
  source: /note="Description of Artificial Sequence: Synthetic Linker"
LVFDDENFTHTPQGNIV

SEQ ID NO: 5556 - protein, 6 aa, Artificial Sequence
  source: /note="Description of Artificial Sequence: Synthetic Linker"
ALPGFQ

SEQ ID NO: 5557 - protein, 14 aa, Artificial Sequence
  source: /note="Description of Artificial Sequence: Synthetic Linker"
RASSVAERHVSPDT

SEQ ID NO: 5558 - protein, 7 aa, Artificial Sequence
  source: /note="Description of Artificial Sequence: Synthetic Linker"
KISSGDW

SEQ ID NO: 5559 - protein, 7 aa, Artificial Sequence
  source: /note="Description of Artificial Sequence: Synthetic Linker"
SKSKNPI

SEQ ID NO: 5560 - protein, 11 aa, Artificial Sequence
  source: /note="Description of Artificial Sequence: Synthetic Linker"
FMNKDGCAGFT

SEQ ID NO: 5561 - protein, 4 aa, Artificial Sequence
  source: /note="Description of Artificial Sequence: Synthetic Linker"
IMGS

SEQ ID NO: 5562 - protein, 4 aa, Artificial Sequence
  source: /note="Description of Artificial Sequence: Synthetic Linker"
KPYK

SEQ ID NO: 5563 - protein, 5 aa, Artificial Sequence
  source: /note="Description of Artificial Sequence: Synthetic Linker"
EGPPM

SEQ ID NO: 5564 - protein, 5 aa, Artificial Sequence
  source: /note="Description of Artificial Sequence: Synthetic Linker"
LGAEI

SEQ ID NO: 5565 - protein, 5 aa, Artificial Sequence
  source: /note="Description of Artificial Sequence: Synthetic Linker"
YIPEK

SEQ ID NO: 5566 - protein, 6 aa, Artificial Sequence
  source: /note="Description of Artificial Sequence: Synthetic Linker"
GEKLNI

SEQ ID NO: 5567 - protein, 6 aa, Artificial Sequence
  source: /note="Description of Artificial Sequence: Synthetic Linker"
NKGYHI

SEQ ID NO: 5568 - protein, 7 aa, Artificial Sequence
  source: /note="Description of Artificial Sequence: Synthetic Linker"
CIETGEI

SEQ ID NO: 5569 - protein, 11 aa, Artificial Sequence
  source: /note="Description of Artificial Sequence: Synthetic Linker"
TGNPLLWSDDL

SEQ ID NO: 5570 - protein, 8 aa, Artificial Sequence
  source: /note="Description of Artificial Sequence: Synthetic Linker"
KHEYQDRF

SEQ ID NO: 5571 - protein, 9 aa, Artificial Sequence
  source: /note="Description of Artificial Sequence: Synthetic Linker"
CRFGYRDSI

SEQ ID NO: 5572 - protein, 9 aa, Artificial Sequence
  source: /note="Description of Artificial Sequence: Synthetic Linker"
RLDPTTVTP

SEQ ID NO: 5573 - protein, 11 aa, Artificial Sequence
  source: /note="Description of Artificial Sequence: Synthetic Linker"
PKEWQPVLTYG

SEQ ID NO: 5574 - protein, 19 aa, Artificial Sequence
  source: /note="Description of Artificial Sequence: Synthetic Linker"
CNTTKCNEGPILELENLPQ

SEQ ID NO: 5575 - protein, 24 aa, Artificial Sequence
  source: /note="Description of Artificial Sequence: Synthetic Linker"
CGLDLCNQGNSGRAVTYSRSRYLE

SEQ ID NO: 5576 - protein, 7 aa, Artificial Sequence
  source: /note="Description of Artificial Sequence: Synthetic Linker"
SFPKDPE

SEQ ID NO: 5577 - protein, 8 aa, Artificial Sequence
  source: /note="Description of Artificial Sequence: Synthetic Linker"
VRTEIAKK

SEQ ID NO: 5578 - protein, 14 aa, Artificial Sequence
  source: /note="Description of Artificial Sequence: Synthetic Linker"
IIRKDQRLKFGEGI

SEQ ID NO: 5579 - protein, 11 aa, Artificial Sequence
  source: /note="Description of Artificial Sequence: Synthetic Linker"
EQLLGTSFLTR

SEQ ID NO: 5580 - protein, 25 aa, Artificial Sequence
  source: /note="Description of Artificial Sequence: Synthetic Linker"
PHDQCACGVLTSEKRAPDLQDLPWQ

SEQ ID NO: 5581 - protein, 8 aa, Artificial Sequence
  source: /note="Description of Artificial Sequence: Synthetic Linker"
KVSGENHV

SEQ ID NO: 5582 - protein, 6 aa, Artificial Sequence
  source: /note="Description of Artificial Sequence: Synthetic Linker"
NVAEDY

SEQ ID NO: 5583 - protein, 4 aa, Artificial Sequence
  source: /note="Description of Artificial Sequence: Synthetic Linker"
IDWR

SEQ ID NO: 5584 - protein, 4 aa, Artificial Sequence
  source: /note="Description of Artificial Sequence: Synthetic Linker"
RKGS

SEQ ID NO: 5585 - protein, 5 aa, Artificial Sequence
  source: /note="Description of Artificial Sequence: Synthetic Linker"
LFKSP

SEQ ID NO: 5586 - protein, 8 aa, Artificial Sequence
  source: /note="Description of Artificial Sequence: Synthetic Linker"
QNLTAPAT

SEQ ID NO: 5587 - protein, 6 aa, Artificial Sequence
  source: /note="Description of Artificial Sequence: Synthetic Linker"
YAPRPR

SEQ ID NO: 5588 - protein, 7 aa, Artificial Sequence
  source: /note="Description of Artificial Sequence: Synthetic Linker"
YGPDGQR

SEQ ID NO: 5589 - protein, 9 aa, Artificial Sequence
  source: /note="Description of Artificial Sequence: Synthetic Linker"
VSQKTFPQL

SEQ ID NO: 5590 - protein, 17 aa, Artificial Sequence
  source: /note="Description of Artificial Sequence: Synthetic Linker"
GVSDDDAFEVGLTCGGI

SEQ ID NO: 5591 - protein, 4 aa, Artificial Sequence
  source: /note="Description of Artificial Sequence: Synthetic Linker"
FNDK

SEQ ID NO: 5592 - protein, 4 aa, Artificial Sequence
  source: /note="Description of Artificial Sequence: Synthetic Linker"
HDRN

SEQ ID NO: 5593 - protein, 5 aa, Artificial Sequence
  source: /note="Description of Artificial Sequence: Synthetic Linker"
KVKAD

SEQ ID NO: 5594 - protein, 6 aa, Artificial Sequence
  source: /note="Description of Artificial Sequence: Synthetic Linker"
EAGISS

SEQ ID NO: 5595 - protein, 6 aa, Artificial Sequence
  source: /note="Description of Artificial Sequence: Synthetic Linker"
IKASWA

SEQ ID NO: 5596 - protein, 6 aa, Artificial Sequence
  source: /note="Description of Artificial Sequence: Synthetic Linker"
LTRGFA

SEQ ID NO: 5597 - protein, 7 aa, Artificial Sequence
  source: /note="Description of Artificial Sequence: Synthetic Linker"
LNGRARA

SEQ ID NO: 5598 - protein, 7 aa, Artificial Sequence
  source: /note="Description of Artificial Sequence: Synthetic Linker"
SLATFDS

SEQ ID NO: 5599 - protein, 8 aa, Artificial Sequence
  source: /note="Description of Artificial Sequence: Synthetic Linker"
ALPEGHAK

SEQ ID NO: 5600 - protein, 8 aa, Artificial Sequence
  source: /note="Description of Artificial Sequence: Synthetic Linker"
ATTGVEGL

SEQ ID NO: 5601 - protein, 8 aa, Artificial Sequence
  source: /note="Description of Artificial Sequence: Synthetic Linker"
RPKSTEKL

SEQ ID NO: 5602 - protein, 9 aa, Artificial Sequence
  source: /note="Description of Artificial Sequence: Synthetic Linker"
YTSRKKTHE

SEQ ID NO: 5603 - protein, 10 aa, Artificial Sequence
  source: /note="Description of Artificial Sequence: Synthetic Linker"
ASPYHLGIND

SEQ ID NO: 5604 - protein, 10 aa, Artificial Sequence
  source: /note="Description of Artificial Sequence: Synthetic Linker"
GLQDWNVTPE

SEQ ID NO: 5605 - protein, 10 aa, Artificial Sequence
  source: /note="Description of Artificial Sequence: Synthetic Linker"
LDRKSGDYNQ

SEQ ID NO: 5606 - protein, 13 aa, Artificial Sequence
  source: /note="Description of Artificial Sequence: Synthetic Linker"
LLDRDLNLNLPPV

SEQ ID NO: 5607 - protein, 13 aa, Artificial Sequence
  source: /note="Description of Artificial Sequence: Synthetic Linker"
SEGLLPLDNHYHF

SEQ ID NO: 5608 - protein, 14 aa, Artificial Sequence
  source: /note="Description of Artificial Sequence: Synthetic Linker"
ESPVDSEQRGENDL

SEQ ID NO: 5609 - protein, 15 aa, Artificial Sequence
  source: /note="Description of Artificial Sequence: Synthetic Linker"
ALHDMNVELEEKTSH

SEQ ID NO: 5610 - protein, 15 aa, Artificial Sequence
  source: /note="Description of Artificial Sequence: Synthetic Linker"
VDKAPYRFTHGWTYS

SEQ ID NO: 5611 - protein, 16 aa, Artificial Sequence
  source: /note="Description of Artificial Sequence: Synthetic Linker"
HRGAHIYMNSWQSIDF

SEQ ID NO: 5612 - protein, 17 aa, Artificial Sequence
  source: /note="Description of Artificial Sequence: Synthetic Linker"
RENGLVRSPGGFPGEDL

SEQ ID NO: 5613 - protein, 18 aa, Artificial Sequence
  source: /note="Description of Artificial Sequence: Synthetic Linker"
VAGVGTRSSDGFQTSGDY

SEQ ID NO: 5614 - protein, 21 aa, Artificial Sequence
  source: /note="Description of Artificial Sequence: Synthetic Linker"
EIHVEQKLPQKLSAKAKELPI

SEQ ID NO: 5615 - protein, 6 aa, Artificial Sequence
  source: /note="Description of Artificial Sequence: Synthetic Linker"
RWQSFN

SEQ ID NO: 5616 - protein, 9 aa, Artificial Sequence
  source: /note="Description of Artificial Sequence: Synthetic Linker"
SLTARPGFL

SEQ ID NO: 5617 - protein, 10 aa, Artificial Sequence
  source: /note="Description of Artificial Sequence: Synthetic Linker"
LRIPFSEHLG

SEQ ID NO: 5618 - protein, 10 aa, Artificial Sequence
  source: /note="Description of Artificial Sequence: Synthetic Linker"
VVGGQQGSLE

SEQ ID NO: 5619 - protein, 13 aa, Artificial Sequence
  source: /note="Description of Artificial Sequence: Synthetic Linker"
DDFDKDTLNINFQ

SEQ ID NO: 5620 - protein, 13 aa, Artificial Sequence
  source: /note="Description of Artificial Sequence: Synthetic Linker"
YGRESLQSKFTQA

SEQ ID NO: 5621 - protein, 18 aa, Artificial Sequence
  source: /note="Description of Artificial Sequence: Synthetic Linker"
VEAPDLPQQEWAPTYEER

SEQ ID NO: 5622 - protein, 31 aa, Artificial Sequence
  source: /note="Description of Artificial Sequence: Synthetic Linker"
IGCPGDTQGDTYLSKGDKRVNEDAVRGLKAE

SEQ ID NO: 5623 - protein, 20 aa, Artificial Sequence
  source: /note="Description of Artificial Sequence: Synthetic Linker"
FQGYYLVSPSETFLERDVLK

SEQ ID NO: 5624 - protein, 6 aa, Artificial Sequence
  source: /note="Description of Artificial Sequence: Synthetic Linker"
GSGSGS

SEQ ID NO: 5625 - DNA, 18 bp, Artificial Sequence
  source: /note="Description of Artificial Sequence: Synthetic Linker"
ggatcaggttccggatcc

SEQ ID NO: 5626 - protein, 8 aa, Artificial Sequence
  source: /note="Description of Artificial Sequence: Synthetic Linker"
GSGSGSGS

SEQ ID NO: 5627 - DNA, 24 bp, Artificial Sequence
  source: /note="Description of Artificial Sequence: Synthetic Linker"
ggatctggttccggatcaggatcc

SEQ ID NO: 5628 - protein, 10 aa, Artificial Sequence
  source: /note="Description of Artificial Sequence: Synthetic Linker"
GSGSGGGSGS

SEQ ID NO: 5629 - DNA, 30 bp, Artificial Sequence
  source: /note="Description of Artificial Sequence: Synthetic Linker"
ggatcaggttccggaggtggatctggatcc

SEQ ID NO: 5630 - protein, 8 aa, Artificial Sequence
  source: /note="Description of Artificial Sequence: Synthetic Linker"
  MOD_RES (2)..(2): Any amino acid
  MOD_RES (4)..(4): Any amino acid
DXEXNPGP

SEQ ID NO: 5631 - protein, 7 aa, Artificial Sequence
  source: /note="Description of Artificial Sequence: Synthetic Linker"
SGSGSGS

SEQ ID NO: 5632 - protein, 10 aa, Artificial Sequence
  source: /note="Description of Artificial Sequence: Synthetic Linker"
  MOD_RES (3)..(4): Any amino acid
  MOD_RES (6)..(9): Any amino acid
HDXXHXXXXN

SEQ ID NO: 5633 - protein, 4 aa, Artificial Sequence
  source: /note="Description of Artificial Sequence: Synthetic Linker"
GSSG

SEQ ID NO: 5634 - DNA, 12 bp, Artificial Sequence
  source: /note="Description of Artificial Sequence: Synthetic Linker"
ggatccagcggc

SEQ ID NO: 5635 - DNA, 603 bp, Artificial Sequence
  source: /note="Description of Artificial Sequence: Synthetic Promoter sequence"
aagcttgggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgactctactaga

SEQ ID NO: 5636 - DNA, 603 bp, Artificial Sequence
  source: /note="Description of Artificial Sequence: Synthetic Promoter sequence"
aagcttgggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttacgggactttcctacttggcagtacatctacgtattagtcatcgctattaccatggtgatgcggttttggcagtacaccaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgactctactaga

SEQ ID NO: 5637 - DNA, 508 bp, Artificial Sequence
  source: /note="Description of Artificial Sequence: Synthetic Promoter sequence"
cgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagct

SEQ ID NO: 5638 - DNA, 1339 bp, Artificial Sequence
  source: /note="Description of Artificial Sequence: Synthetic Promoter sequence"
cgatagtaattcatacaaaaggactcgcccctgccttggggaatcccagggaccgtcgttaaactcccactaacgtagaacccagagatcgctgcgttcccgccccctcacccgcccgctctcgtcatcactgaggtggagaagagcatgcgtgaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacgcccctggctgcagtacgtgattcttgatcccgagcttcgggttggaagtgggtgggagagttcgaggccttgcgcttaaggagccccttcgcctcgtgcttgagttgaggcctggcttgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgag

SEQ ID NO: 5639 - DNA, 1335 bp, Artificial Sequence
  source: /note="Description of Artificial Sequence: Synthetic Promoter sequence"
gagtaattcatacaaaaggactcgcccctgccttggggaatcccagggaccgtcgttaaactcccactaacgtagaacccagagatcgctgcgttcccgccccctcacccgcccgctctcgtcatcactgaggtggagaagagcatgcgtgaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacgcccctggctgcagtacgtgattcttgatcccgagcttcgggttggaagtgggtgggagagttcgaggccttgcgcttaaggagccccttcgcctcgtgcttgagttgaggcctggcttgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtga

SEQ ID NO: 5640 - DNA, 1184 bp, Artificial Sequence
  source: /note="Description of Artificial Sequence: Synthetic Promoter sequence"
cgtgaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtga

SEQ ID NO: 5641 - DNA, 1184 bp, Artificial Sequence
  source: /note="Description of Artificial Sequence: Synthetic Promoter sequence"
cgtgaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccactgagtaccgggcgccgtccaggcacctcgattagttctcgtgcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtga

SEQ ID NO: 5642 - DNA, 1184 bp, Artificial Sequence
  source: /note="Description of Artificial Sequence: Synthetic Promoter sequence"
cgtgaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccactgagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtga

SEQ ID NO: 5643 - DNA, 521 bp, Artificial Sequence
  source: /note="Description of Artificial Sequence: Synthetic Promoter sequence"
acccctctctccagccactaagccagttgctccctcggctgacggctgcacgcgaggcctccgaacgtcttacgccttgtggcgcgcccgtccttgtcccgggtgtgatggcggggtgtggggcggagggcgtggcggggaagggccggcgacgagagccgcgcgggacgactcgtcggcgataaccggtgtcgggtagcgccagccgcgcgacggtaacgagggaccgcgacaggcagacgctcccatgatcactctgcacgccgaaggcaaatagtgcaggccgtgcggcgcttggcgttccttggaagggctgaatccccgcctcgtccttcgcagcggccccccgggtgttcccatcgccgcttctaggcccactgcgacgcttgcctgcacttcttacacgctctgggtcccagccgcggcgacgcaaagggccttggtgcgggtctcgtcggcgcagggacgcgtttgggtcccgacggaaccttttccgcgttggggttggggcaccataagct

SEQ ID NO: 5644 - DNA, 118 bp, Artificial Sequence
  source: /note="Description of Artificial Sequence: Synthetic Promoter sequence"
acccctctctccagccactaagccagttgctccctcggctgacggctgcacgcgaggcctccgaacgtcttacgccttgtggcgcgcccgtccttgtcccgggtgtgatggcggggtg

SEQ ID NO: 5645 - DNA, 221 bp, Artificial Sequence
  source: /note="Description of Artificial Sequence: Synthetic Promoter sequence"
acccctctctccagccactaagccagttgctccctcggctgacggctgcacgcgaggcctccgaacgtcttacgccttgtggcgcgcccgtccttgtcccgggtgtgatggcggggtgtggggcggagggcgtggcggggaagggccggcgacgagagccgcgcgggacgactcgtcggcgataaccggtgtcgggtagcgccagccgcgcgacggtaacg

SEQ ID NO: 5646 - DNA, 324 bp, Artificial Sequence
  source: /note="Description of Artificial Sequence: Synthetic Promoter sequence"
acccctctctccagccactaagccagttgctccctcggctgacggctgcacgcgaggcctccgaacgtcttacgccttgtggcgcgcccgtccttgtcccgggtgtgatggcggggtgtggggcggagggcgtggcggggaagggccggcgacgagagccgcgcgggacgactcgtcggcgataaccggtgtcgggtagcgccagccgcgcgacggtaacgagggaccgcgacaggcagacgctcccatgatcactctgcacgccgaaggcaaatagtgcaggccgtgcggcgcttggcgttccttggaagggctgaatccccg

SEQ ID NO: 5647 - DNA, 422 bp, Artificial Sequence
  source: /note="Description of Artificial Sequence: Synthetic Promoter sequence"
acccctctctccagccactaagccagttgctccctcggctgacggctgcacgcgaggcctccgaacgtcttacgccttgtggcgcgcccgtccttgtcccgggtgtgatggcggggtgtggggcggagggcgtggcggggaagggccggcgacgagagccgcgcgggacgactcgtcggcgataaccggtgtcgggtagcgccagccgcgcgacggtaacgagggaccgcgacaggcagacgctcccatgatcactctgcacgccgaaggcaaatagtgcaggccgtgcggcgcttggcgttccttggaagggctgaatccccgcctcgtccttcgcagcggccccccgggtgttcccatcgccgcttctaggcccactgcgacgcttgcctgcacttcttacacgctctgggtcccagccg

SEQ ID NO: 5648 - DNA, 512 bp, Artificial Sequence
  source: /note="Description of Artificial Sequence: Synthetic Promoter sequence"
atcgatgggtaggggaggcgcttttcccaaggcagtctggagcatgcgctttagcagccccgctgggcacttggcgctacacaagtggcctctggcctcgcacacattccacatccaccggtaggcgccaaccggctccgttctttggtggccccttcgcgccaccttctactcctcccctagtcaggaagttcccccccgccccgcagctcgcgtcgtgcaggacgtgacaaatggaagtagcacgtctcactagtctcgtgcagatggacagcaccgctgagcaatggaagcgggtaggcctttggggcagcggccaatagcagctttgctccttcgctttctgggctcagaggctgggaaggggtgggtccgggggcgggctcaggggcgggctcaggggcggggcgggcgcccgaaggtcctccggaggcccggcattctgcacgcttcaaaagcgcacgtctgccgcgctgttctcctcttcctcatctccgggcctttcgctcgag

SEQ ID NO: 5649 - DNA, 507 bp, Artificial Sequence
  source: /note="Description of Artificial Sequence: Synthetic Promoter sequence"
atcgatgggtaggggaggcgcttttcccaaggcagtctggagcatgcgctttagcagccccgctgggcacttggcgctacacaagtggcctctggcctcgcacacattccacatccaccggtaggcgccaaccggctccgttctttggtggccccttcgcgccaccttctactcctcccctagtcaggaagttcccccccgccccgcagctcgcgtcgtgcaggacgtgacaaatggaagtagcacgtctcactagtctcgtgcagatggacagcaccgctgagcaatggaagcgggtaggcctttggggcagcggccaatagcagctttgctccttcgctttctgggctcagaggctgggaaggggtgggtccgggggcgggctcaggggcgggctcaggggcggggcgggcgcccgaaggtcctccggaggcccggcattctgcacgcttcaaaagcgcacgtctgccgcgctgttctcctcttcctcatctccgggcctttcgc

SEQ ID NO: 5650 - DNA, 399 bp, Artificial Sequence
  source: /note="Description of Artificial Sequence: Synthetic Promoter sequence"
ccggtaggcgccaaccggctccgttctttggtggccccttcgcgccaccttctactcctcccctagtcaggaagttcccccccgccccgcagctcgcgtcgtgcaggacgtgacaaatggaagtagcacgtctcactagtctcgtgcagatggacagcaccgctgagcaatggaagcgggtaggcctttggggcagcggccaatagcagctttgctccttcgctttctgggctcagaggctgggaaggggtgggtccgggggcgggctcaggggcgggctcaggggcggggcgggcgcccgaaggtcctccggaggcccggcattctgcacgcttcaaaagcgcacgtctgccgcgctgttctcctcttcctcatctccgggcctttcgacctgcagcc

SEQ ID NO: 5651 - protein, 259 aa, Artificial Sequence
  source: /note="Description of Artificial Sequence: Synthetic Destabilizing Domain (DD)"
SHHWGYGKHNGPEHWHKDFPIAKGERQSPVDIDTHTAKYDPSLKPLSVSYDQATSLRILNNGHAFNVEFDDSQDKAVLKGGPLDGTYRLIQFHFHWGSLDGQGSEHTVDKKKYAAELHLVHWNTKYGDFGKAVQQPDGLAVLGIFLKVGSAKPGLQKVVDVLDSIKTKGKSADFTNFDPRGLLPESLDYWTYPGSLTTPPLLECVTWIVLKEPISVSSEQVLKFRKLNFNGEGEPEELMVDNWRPAQPLKNRQIKASFK

SEQ ID NO: 5652 - DNA, 777 bp, Artificial Sequence
  source: /note="Description of Artificial Sequence: Synthetic Destabilizing Domain (DD)"
tcccatcactgggggtacggcaaacacaacggacctgagcactggcataaggacttccccattgccaagggagagcgccagtcccctgttgacatcgacactcatacagccaagtatgacccttccctgaagcccctgtctgtttcctatgatcaagcaacttccctgaggatcctcaacaatggtcatgctttcaacgtggagtttgatgactctcaggacaaagcagtgctcaagggaggacccctggatggcacttacagattgattcagtttcactttcactggggttcacttgatggacaaggttcagagcatactgtggataaaaagaaatatgctgcagaacttcacttggttcactggaacaccaaatatggggattttgggaaagctgtgcagcaacctgatggactggccgttctaggtatttttttgaaggttggcagcgctaaaccgggccttcagaaagttgttgatgtgctggattccattaaaacaaagggcaagagtgctgacttcactaacttcgatcctcgtggcctccttcctgaatccctggattactggacctacccaggctcactgaccacccctcctcttctggaatgtgtgacctggattgtgctcaaggaacccatcagcgtcagcagcgagcaggtgttgaaattccgtaaacttaacttcaatggggagggtgaacccgaagaactgatggtggacaactggcgcccagctcagccactgaagaacaggcaaatcaaagcttccttcaaa

SEQ ID NO: 5653 - protein, 259 aa, Artificial Sequence
  source: /note="Description of Artificial Sequence: Synthetic Destabilizing Domain (DD)"
SHHWGYGKHNGPEHWHKDFPIAKGERQSPVDIDTHTAKYDPSLKPLSVSYDQATSLRILNNGHAFNVEFDDSQDKAVLKGGPLDGTYRLIQFHFHWGSLDGQGSEHTVDKKKYAAELHLVHWNTKYGDFGKAVQQPDGLAVLGIFLKVGSAKPGLQKVVDVLDSIKTKGKSADFTNFDPRGLLPESLDYWTYPGSLTTPPLLECVTSIVLKEPISVSSEQVLKFRKLNFNGEGEPEELMVDNWRPAQPLKNRQIKASFK

SEQ ID NO: 5654 - DNA, 777 bp, Artificial Sequence
  source: /note="Description of Artificial Sequence: Synthetic Destabilizing Domain (DD)"
tcccatcactgggggtacggcaaacacaacggacctgagcactggcataaggacttccccattgccaagggagagcgccagtcccctgttgacatcgacactcatacagccaagtatgacccttccctgaagcccctgtctgtttcctatgatcaagcaacttccctgaggatcctcaacaatggtcatgctttcaacgtggagtttgatgactctcaggacaaagcagtgctcaagggaggacccctggatggcacttacagattgattcagtttcactttcactggggttcacttgatggacaaggttcagagcatactgtggataaaaagaaatatgctgcagaacttcacttggttcactggaacaccaaatatggggattttgggaaagctgtgcagcaacctgatggactggccgttctaggtatttttttgaaggttggcagcgctaaaccgggccttcagaaagttgttgatgtgctggattccattaaaacaaagggcaagagtgctgacttcactaacttcgatcctcgtggcctccttcctgaatccctggattactggacctacccaggctcactgaccacccctcctcttctggaatgtgtgaccagcattgtgctcaaggaacccatcagcgtcagcagcgagcaggtgttgaaattccgtaaacttaacttcaatggggagggtgaacccgaagaactgatggtggacaactggcgcccagctcagccactgaagaacaggcaaatcaaagcttccttcaaa

SEQ ID NO: 5655 - protein, 259 aa, Artificial Sequence
  source: /note="Description of Artificial Sequence: Synthetic Destabilizing Domain (DD)"
SHHWGYGKHNGPEHWHKDFPIAKGERQSPVDIDTHTAKYDPSLKPLSVSNDQATSLRILNNGHAFNVEFDDSQDKAVLKGGPLDGTYRLIQFHFHWGSLDGQGSEHTVDKKKYAAELHLVHWNTKYGDFGKAVQQPDGLAVLGIFLKVGSAKPGLQKVVDVLDSIKTKGKSADFTNFDPRGLLPESLDYWTYPGSLTTPPLLECVTWIVLKEPISVSSEQVLKFRKLNFNGEGEPEELMVDNWRPAQPLKNRQIKASFK

SEQ ID NO: 5656 - DNA, 777 bp, Artificial Sequence
  source: /note="Description of Artificial Sequence: Synthetic Destabilizing Domain (DD)"
tcccatcactgggggtacggcaaacacaacggacctgagcactggcataaggacttccccattgccaagggagagcgccagtcccctgttgacatcgacactcatacagccaagtatgacccttccctgaagcccctgtctgtttccaatgatcaagcaacttccctgaggatcctcaacaatggtcatgctttcaacgtggagtttgatgactctcaggacaaagcagtgctcaagggaggacccctggatggcacttacagattgattcagtttcactttcactggggttcacttgatggacaaggttcagagcatactgtggataaaaagaaatatgctgcagaacttcacttggttcactggaacaccaaatatggggattttgggaaagctgtgcagcaacctgatggactggccgttctaggtatttttttgaaggttggcagcgctaaaccgggccttcagaaagttgttgatgtgctggattccattaaaacaaagggcaagagtgctgacttcactaacttcgatcctcgtggcctccttcctgaatccctggattactggacctacccaggctcactgaccacccctcctcttctggaatgtgtgacctggattgtgctcaaggaacccatcagcgtcagcagcgagcaggtgttgaaattccgtaaacttaacttcaatggggagggtgaacccgaagaactgatggtggacaactggcgcccagctcagccactgaagaacaggcaaatcaaagcttccttcaaa

SEQ ID NO: 5657 - protein, 259 aa, Artificial Sequence
  source: /note="Description of Artificial Sequence: Synthetic Destabilizing Domain (DD)"
SHHWGYGKHNGPEHWHKDFPIAKGERQSPVDIDTHTAKYDPSLKPLSVSYDQATNLRILNNGHAFNVEFDDSQDKAVLKGGPLDGTYRLIQFHFHWGSLDGQGSEHTVDKKKYAAELHLVHWNTKYGDFGKAVQQPDGLAVLGIFLKVGSAKPGLQKVVDVLDSIKTKGKSADFTNFDPRGLLPESLDYWTYPGSLTTPPLLECVTWIVLKEPISVSSEQVLKFRKLNFNGEGEPEELMVDNWRPAQPLKNRQIKASFK

SEQ ID NO: 5658 - DNA, 777 bp, Artificial Sequence
  source: /note="Description of Artificial Sequence: Synthetic Destabilizing Domain (DD)"
tcccatcactgggggtacggcaaacacaacggacctgagcactggcataaggacttccccattgccaagggagagcgccagtcccctgttgacatcgacactcatacagccaagtatgacccttccctgaagcccctgtctgtttcctatgatcaagcaactaatctgaggatcctcaacaatggtcatgctttcaacgtggagtttgatgactctcaggacaaagcagtgctcaagggaggacccctggatggcacttacagattgattcagtttcactttcactggggttcacttgatggacaaggttcagagcatactgtggataaaaagaaatatgctgcagaacttcacttggttcactggaacaccaaatatggggattttgggaaagctgtgcagcaacctgatggactggccgttctaggtatttttttgaaggttggcagcgctaaaccgggccttcagaaagttgttgatgtgctggattccattaaaacaaagggcaagagtgctgacttcactaacttcgatcctcgtggcctccttcctgaatccctggattactggacctacccaggctcactgaccacccctcctcttctggaatgtgtgacctggattgtgctcaaggaacccatcagcgtcagcagcgagcaggtgttgaaattccgtaaacttaacttcaatggggagggtgaacccgaagaactgatggtggacaactggcgcccagctcagccactgaagaacaggcaaatcaaagcttccttcaaa

SEQ ID NO: 5659 - protein, 259 aa, Artificial Sequence
  source: /note="Description of Artificial Sequence: Synthetic Destabilizing Domain (DD)"
SHHWGYGKHNGPEHWHKDFPIAKGERQSPVDIDTHTAKYDPSLKPLSVSTDQATSLRILNNGHAFNVEFDDSQDKAVLKGGPLDGTYRLIQFHFHWGSLDGQGSEHTVDKKKYAAELHLVHWNTKYGDFGKAVQQPDGLAVLGIFLKVGSAKPGLQKVVDVLDSIKTKGKSADFTNFDPRGLLPESLDYWTYPGSLTTPPLLECVTWIVLKEPISVSSEQVLKFRKLNFNGEGEPEELMVDNWRPAQPLKNRQIKASFK

SEQ ID NO: 5660 - DNA, 777 bp, Artificial Sequence
  source: /note="Description of Artificial Sequence: Synthetic Destabilizing Domain (DD)"
tcccatcactgggggtacggcaaacacaacggacctgagcactggcataaggacttccccattgccaagggagagcgccagtcccctgttgacatcgacactcatacagccaagtatgacccttccctgaagcccctgtctgtttccactgatcaagcaacttccctgaggatcctcaacaatggtcatgctttcaacgtggagtttgatgactctcaggacaaagcagtgctcaagggaggacccctggatggcacttacagattgattcagtttcactttcactggggttcacttgatggacaaggttcagagcatactgtggataaaaagaaatatgctgcagaacttcacttggttcactggaacaccaaatatggggattttgggaaagctgtgcagcaacctgatggactggccgttctaggtatttttttgaaggttggcagcgctaaaccgggccttcagaaagttgttgatgtgctggactccattaaaacaaagggcaagagtgctgacttcactaacttcgatcctcgtggcctccttcctgaatccctggattactggacctacccaggctcactgaccacccctcctcttctggaatgtgtgacctggattgtgctcaaggaacccatcagcgtcagcagcgagcaggtgttgaaattccgtaaacttaacttcaatggggagggtgaacccgaagaactgatggtggacaactggcgcccagctcagccactgaagaacaggcaaatcaaagcttccttcaaa

SEQ ID NO: 5661 - DNA, 777 bp, Artificial Sequence
  source: /note="Description of Artificial Sequence: Synthetic Destabilizing Domain (DD)"
tcccatcactgggggtacggcaaacacaacggacctgagcactggcataaggacttccccattgccaagggagagcgccagtcccctgttgacatcgacactcatacagccaagtatgacccttccctgaagcccctgtctgtttccactgatcaagcaacttccctgaggatcctcaacaatggtcatgctttcaacgtggagtttgatgactctcaggacaaagcagtgctcaagggaggacccctggatggcacttacagattgattcagtttcactttcactggggttcacttgatggacaaggttcagagcatactgtggataaaaagaaatatgctgcagaacttcacttggttcactggaacaccaaatatggggattttgggaaagctgtgcagcaacctgatggactggccgttctaggtatttttttgaaggttggcagcgctaaaccgggccttcagaaagttgttgatgtgctggattccattaaaacaaagggcaagagtgctgacttcactaacttcgatcctcgtggcctccttcctgaatccctggattactggacctacccaggctcactgaccacccctcctcttctggaatgtgtgacctggattgtgctcaaggaacccatcagcgtcagcagcgagcaggtgttgaaattccgtaaacttaacttcaatggggagggtgaacccgaagaactgatggtggacaactggcgcccagctcagccactgaagaacaggcaaatcaaagcttccttcaaa

SEQ ID NO: 5662 - protein, 259 aa, Artificial Sequence
  source: /note="Description of Artificial Sequence: Synthetic Destabilizing Domain (DD)"
SHHWGYGKHNGPEHWHKDFPIAKGERQSPVDIDTHTAKYDPSLKPLSVSYDQATSLRILNNGHAFNVEFDFSQDKAVLKGGPLDGTYRLIQFHFHWGSLDGQGSEHTVDKKKYAAELHLVHWNTKYGDFGKAVQQPDGLAVLGIFLKVGSAKPGLQKVVDVLDSIKTKGKSADFTNFDPRGLLPESLDYWTYPGSLTTPPLLECVTWIVLKEPISVSSEQVLKFRKLNFNGEGEPEELMFDNWRPAQLLKNRQIKASFK

SEQ ID NO: 5663 - DNA, 777 bp, Artificial Sequence
  source: /note="Description of Artificial Sequence: Synthetic Destabilizing Domain (DD)"
tcccatcactgggggtacggcaaacacaacggacctgagcactggcataaggacttccccattgccaagggagagcgccagtcccctgttgacatcgacactcatacagccaagtatgacccttccctgaagcccctgtctgtttcctatgatcaagcaacttccctgaggatcctcaacaatggtcatgctttcaacgtggagtttgatttttctcaggacaaagcagtgctcaagggaggacccctggatggcacttacagattgattcagtttcactttcactggggttcacttgatggacaaggttcagagcatactgtggataaaaagaaatatgctgcagaacttcacttggttcactggaacaccaaatatggggattttgggaaagctgtgcagcaacctgatggactggccgttctaggtatttttttgaaggttggcagcgctaaaccgggccttcagaaagttgttgatgtgctggattccattaaaacaaagggcaagagtgctgacttcactaacttcgatcctcgtggcctccttcctgaatccctggattactggacctacccaggctcactgaccacccctcctcttctggaatgtgtgacctggattgtgctcaaggaacccatcagcgtcagcagcgagcaggtgttgaaattccgtaaacttaacttcaatggggagggtgaacccgaagaactgatgtttgacaactggcgcccagctcagttgctgaagaacaggcaaatcaaagcttccttcaaa

SEQ ID NO: 5664 - protein, 259 aa, Artificial Sequence
  source: /note="Description of Artificial Sequence: Synthetic Destabilizing Domain (DD)"
SHHWGYGKHNGPEHWHKDFPIAKGERQSPVDIDTHTAKYDPSLKPLSVSYDQATSLRILNNGHAFNVEFFDSQDKAVLKGGPLDGTYRLIQFHFHWGSLDGQGSEHTVDKKKYAAELHLVHWNTKYGDFGKAVQQPDGLAVLGIFLKVGSAKPGLQKVVDVLDSIKTKGKSADFTNFDPRGLLPESLDYWTYPGSLTTPPLLECVTWIVLKEPISVSSEQVLKFRKLNFFGEGEPEELMVDNWRPAQPLKNRQIKASFK

SEQ ID NO: 5665 - DNA, 777 bp, Artificial Sequence
  source: /note="Description of Artificial Sequence: Synthetic Destabilizing Domain (DD)"
tcccatcactgggggtacggcaaacacaacggacctgagcactggcataaggacttccccattgccaagggagagcgccagtcccctgttgacatcgacactcatacagccaagtatgacccttccctgaagcccctgtctgtttcctatgatcaagcaacttccctgaggatcctcaacaatggtcatgctttcaacgtggagttttttgactctcaggacaaagcagtgctcaagggaggacccctggatggcacttacagattgattcagtttcactttcactggggttcacttgatggacaaggttcagagcatactgtggataaaaagaaatatgctgcagaacttcacttggttcactggaacaccaaatatggggattttgggaaagctgtgcagcaacctgatggactggccgttctaggtatttttttgaaggttggcagcgctaaaccgggccttcagaaagttgttgatgtgctggattccattaaaacaaagggcaagagtgctgacttcactaacttcgatcctcgtggcctccttcctgaatccctggattactggacctacccaggctcactgaccacccctcctcttctggaatgtgtgacctggattgtgctcaaggaacccatcagcgtcagcagcgagcaggtgttgaaattccgtaaacttaacttctttggggagggtgaacccgaagaactgatggtggacaactggcgcccagctcagccactgaagaacaggcaaatcaaagcttccttcaaa

SEQ ID NO: 5666 - protein, 259 aa, Artificial Sequence
  source: /note="Description of Artificial Sequence: Synthetic Destabilizing Domain (DD)"
SHHWGYGKHNGPEHWHKDFPIAKGERQSPVDIDTHTAKYDPSLKPLSVSYDQATFLRILNNGHAFNVEFDDSQDKAVLKGGPLDGTYRLIQFHFHWGSLDGQGSEHTVDKKKYAAELHLVHWNTKYGDFGKAVQQPDGLAVLGIFLKVGSAKPGLQKVVDVLDSIKTKGKSADFTNFDPRGLLPESLDYWTYPGSLTTPPLLECVTWIVLKEPISVSSEQVLKFRKLNFNGEGEPEELMVDNWRPAQPLKNRQIKASFK

SEQ ID NO: 5667 - DNA, 777 bp, Artificial Sequence
  source: /note="Description of Artificial Sequence: Synthetic Destabilizing Domain (DD)"
tcccatcactgggggtacggcaaacacaacggacctgagcactggcataaggacttccccattgccaagggagagcgccagtcccctgttgacatcgacactcatacagccaagtatgacccttccctgaagcccctgtctgtttcctatgatcaagcaacttttctgaggatcctcaacaatggtcatgctttcaacgtggagtttgatgactctcaggacaaagcagtgctcaagggaggacccctggatggcacttacagattgattcagtttcactttcactggggttcacttgatggacaaggttcagagcatactgtggataaaaagaaatatgctgcagaacttcacttggttcactggaacaccaaatatggggattttgggaaagctgtgcagcaacctgatggactggccgttctaggtatttttttgaaggttggcagcgctaaaccgggccttcagaaagttgttgatgtgctggattccattaaaacaaagggcaagagtgctgacttcactaacttcgatcctcgtggcctccttcctgaatccctggattactggacctacccaggctcactgaccacccctcctcttctggaatgtgtgacctggattgtgctcaaggaacccatcagcgtcagcagcgagcaggtgttgaaattccgtaaacttaacttcaatggggagggtgaacccgaagaactgatggtggacaactggcgcccagctcagccactgaagaacaggcaaatcaaagcttccttcaaa

SEQ ID NO: 5668 - DNA, 777 bp, Artificial Sequence
  source: /note="Description of Artificial Sequence: Synthetic Destabilizing Domain (DD)"
tcccatcactgggggtacggcaaacacaacggacctgagcactggcataaggacttccccattgccaagggagagcgccagtcccctgttgacatcgacactcatacagccaagtatgacccttccctgaagcccctgtctgtttcctatgatcaagcaacttttctaaggatcctcaacaatggtcatgctttcaacgtggagtttgatgactctcaggacaaagcagtgctcaagggaggacccctggatggcacttacagattgattcagtttcactttcactggggttcacttgatggacaaggttcagagcatactgtggataaaaagaaatatgctgcagaacttcacttggttcactggaacaccaaatatggggattttgggaaagctgtgcagcaacctgatggactggccgttctaggtatttttttgaaggttggcagcgctaaaccgggccttcagaaagttgttgatgtgctggattccattaaaacaaagggcaagagtgctgacttcactaacttcgatcctcgtggcctccttcctgaatccctggattactggacctacccaggctcactgaccacccctcctcttctggaatgtgtgacctggattgtgctcaaggaacccatcagcgtcagcagcgagcaggtgttgaaattccgtaaacttaacttcaatggggagggtgaacccgaagaactgatggtggacaactggcgcccagctcagccactgaagaacaggcaaatcaaagcttccttcaaa

SEQ ID NO: 5669 - protein, 259 aa, Artificial Sequence
  source: /note="Description of Artificial Sequence: Synthetic Destabilizing Domain (DD)"
SHHWGYGKHNGPEHWHKDFPIAKGERQSPVDIDTHTAKYDPSLKPLSVSYDQATSLRILNNGHAFNVEFLDSQDKAVLKGGPLDGNYRLIQFHFHWGSLDGQGSEHTVDKKKYAAELHLVHWNTKYGDFGKAVQQPDGLAVLGIFLKVGSAKPGLQKVVDVLDSIKTKGKSADFTNFDPRGLLPESLDYWTYPGSLTTPPLLECVTWIVLKEPISVSSEQVLKFRKLNFNGEGEPEELMVDNWRPAQPRKNRQIKASFK

SEQ ID NO: 5670 - DNA, 777 bp, Artificial Sequence
  source: /note="Description of Artificial Sequence: Synthetic Destabilizing Domain (DD)"
tcccatcactgggggtacggcaaacacaacggacctgagcactggcataaggacttccccattgccaagggagagcgccagtcccctgttgacatcgacactcatacagccaagtatgacccttccctgaagcccctgtctgtttcctatgatcaagcaacttccctgaggatcctcaacaatggtcatgctttcaacgtggagtttttggactctcaggacaaagcagtgctcaagggaggacccctggatggcaattacagattgattcagtttcactttcactggggttcacttgatggacaaggttcagagcatactgtggataaaaagaaatatgctgcagaacttcacttggttcactggaacaccaaatatggggattttgggaaagctgtgcagcaacctgatggactggccgttctaggtatttttttgaaggttggcagcgctaaaccgggccttcagaaagttgttgatgtgctggattccattaaaacaaagggcaagagtgctgacttcactaacttcgatcctcgtggcctccttcctgaatccctggattactggacctacccaggctcactgaccacccctcctcttctggaatgtgtgacctggattgtgctcaaggaacccatcagcgtcagcagcgagcaggtgttgaaattccgtaaacttaacttcaatggggagggtgaacccgaagaactgatggtggacaactggcgcccagctcagccacggaagaacaggcaaatcaaagcttccttcaaa

SEQ ID NO: 5671 - protein, 259 aa, Artificial Sequence
  source: /note="Description of Artificial Sequence: Synthetic Destabilizing Domain (DD)"
SHHWGYGKHNGPEHWHKDFPIAKGERQSPVDIDTHTAKYDPSLKPLSVSYDQATSLRILNNGHAFNVEFDDSQDKAVLKGGPLDGTYRLIQFHFHWGSLDGQGSEHTVDKKKYAAELHLVHWNTKYGDFGKAVQQPDGLAVLGIFLKVGSAKPGLQKVVDVLDSIKTKGKSADFTNFDPRGSLPESLDYWTYPGSLTTPPLLECVTWIVLKEPISVSSEQVLKFRKLNFNGEGEPEELMVDNWRPAQPLKNRQIKASFK

SEQ ID NO: 5672 - DNA, 777 bp, Artificial Sequence
  source: /note="Description of Artificial Sequence: Synthetic Destabilizing Domain (DD)"
tcccatcactgggggtacggcaaacacaacggacctgagcactggcataaggacttccccattgccaagggagagcgccagtcccctgttgacatcgacactcatacagccaagtatgacccttccctgaagcccctgtctgtttcctatgatcaagcaacttccctgaggatcctcaacaatggtcatgctttcaacgtggagtttgatgactctcaggacaaagcagtgctcaagggaggacccctggatggcacttacagattgattcagtttcactttcactggggttcacttgatggacaaggttcagagcatactgtggataaaaagaaatatgctgcagaacttcacttggttcactggaacaccaaatatggggattttgggaaagctgtgcagcaacctgatggactggccgttctaggtatttttttgaaggttggcagcgctaaaccgggccttcagaaagttgttgatgtgctggattccattaaaacaaagggcaagagtgctgacttcactaacttcgatcctcgtggcagtcttcctgaatccctggattactggacctacccaggctcactgaccacccctcctcttctggaatgtgtgacctggattgtgctcaaggaacccatcagcgtcagcagcgagcaggtgttgaaattccgtaaacttaacttcaatggggagggtgaacccgaagaactgatggtggacaactggcgcccagctcagccactgaagaacaggcaaatcaaagcttccttcaaa

SEQ ID NO: 5673 - protein, 259 aa, Artificial Sequence
  source: /note="Description of Artificial Sequence: Synthetic Destabilizing Domain (DD)"
SHHWGYGKHNGPEHWHKDFPIAKGERQSPVDIDTHTAKYDPSLKPLSVSYDQATSLRILNNGHAFNVEFDDSQDKIVLKGGPLDGTYRLIQFHFHWGSLDGQGSEHTVDKKKYAAELHLVHWNTKYGDFGKAVQQPDGLAVLGIFLKVGSAKPGLQKVVDVLDSIKTKGKSADFTNFDPRGLLPESLDYWTYPGSLTTPPLLECVTWIVLKEPISVSSEQVLKFRKLNFNGEGEPEELMVDNWRPAQFLKNRQIKASFK

SEQ ID NO: 5674 - DNA, 777 bp, Artificial Sequence
  source: /note="Description of Artificial Sequence: Synthetic Destabilizing Domain (DD)"
tcccatcactgggggtacggcaaacacaacggacctgagcactggcataaggacttccccattgccaagggagagcgccagtcccctgttgacatcgacactcatacagccaagtatgacccttccctgaagcccctgtctgtttcctatgatcaagcaacttccctgaggatcctcaacaatggtcatgctttcaacgtggagtttgatgactctcaggacaaaattgtgctcaagggaggacccctggatggcacttacagattgattcagtttcactttcactggggttcacttgatggacaaggttcagagcatactgtggataaaaagaaatatgctgcagaacttcacttggttcactggaacaccaaatatggggattttgggaaagctgtgcagcaacctgatggactggccgttctaggtatttttttgaaggttggcagcgctaaaccgggccttcagaaagttgttgatgtgctggattccattaaaacaaagggcaagagtgctgacttcactaacttcgatcctcgtggcctccttcctgaatccctggattactggacctacccaggctcactgaccacccctcctcttctggaatgtgtgacctggattgtgctcaaggaacccatcagcgtcagcagcgagcaggtgttgaaatttcgtaaacttaacttcaatggggagggtgaacccgaagaactgatggtggacaactggcgcccagctcagtttctgaagaacaggcaaatcaaagcttccttcaaa

SEQ ID NO: 5675 - protein, 259 aa, Artificial Sequence
  source: /note="Description of Artificial Sequence: Synthetic Destabilizing Domain (DD)"
SHHWGYGKHNGPEHWHKDFPIAKGERQSPVDIDTHTAKYDPSLKPLSVSYDQATSLRILNNGHAFNVEFKDSQDKAVLKGGPLDGTYRLIQFHFHWGSLDGQGSEHTVDKKKYAAELHLVHWNTKYGDFGKAVQQPDGLAVLGIFLKVGSAKPGLQKVVDVLDSIKTKGKSADFTNFDPRGLLPESLDYWTYPGSLTTPPLLECVTWIVLKEPISVSSEQVLKFRKLNFNGEGEPEELMVDNWRPAQHLKNRQIKASFK

SEQ ID NO: 5676 - DNA, 777 bp, Artificial Sequence
  source: /note="Description of Artificial Sequence: Synthetic Destabilizing Domain (DD)"
tcccatcactgggggtacggcaaacacaacggacctgagcactggcataaggacttccccattgccaagggagagcgccagtcccctgttgacatcgacactcatacagccaagtatgacccttccctgaagcccctgtctgtttcctatgatcaagcaacttccctgaggatcctcaacaatggtcatgctttcaacgtggagtttaaggactctcaggacaaagcagtgctcaagggaggacccctggatggcacttacagattgattcagtttcactttcactggggttcacttgatggacaaggttcagagcatactgtggataaaaagaaatatgctgcagaacttcacttggttcactggaacaccaaatatggggattttgggaaagctgtgcagcaacctgatggactggccgttctaggtatttttttgaaggttggcagcgctaaaccgggccttcagaaagttgttgatgtgctggattccattaaaacaaagggcaagagtgctgacttcactaacttcgatcctcgtggcctccttcctgaatccctggattactggacctacccaggctcactgaccacccctcctcttctggaatgtgtgacctggattgtgctcaaggaacccatcagcgtcagcagcgagcaggtgttgaaattccgtaaacttaacttcaatggggagggtgaacccgaagaactgatggtggacaactggcgcccagctcagcatctgaagaacaggcaaatcaaagcttccttcaaa

SEQ ID NO: 5677 - protein, 259 aa, Artificial Sequence
  source: /note="Description of Artificial Sequence: Synthetic Destabilizing Domain (DD)"
SHHWGYGKHNGPEHWHKDFPIAKGERQSPVDIDTHTAKYDPSLKPLSVSYDQATSLRILNNGHAFNVEFDFSQDKAVLKGGPLDGTYRLIQFHFHWGSLDGQGSEHTVDKKKYAAELHLVHWNTKYGDFGKAVQQPDGLAVLGIFLKVGSAKPGLQKVVDVLDSIKTKGKSADFTNFDPRGLLPESLDYWTYPGSLTTPPLLECVTWIVLKEPISVSSEQVLKFRKLNFNGEGEPEELMVDNWRPAQFLKNRQIKASFK

SEQ ID NO: 5678 - DNA, 777 bp, Artificial Sequence
  source: /note="Description of Artificial Sequence: Synthetic Destabilizing Domain (DD)"
tcccatcactgggggtacggcaaacacaacggacctgagcactggcataaggacttccccattgccaagggagagcgccagtcccctgttgacatcgacactcatacagccaagtatgacccttccctgaagcccctgtctgtttcctatgatcaagcaacttccctgaggatcctcaacaatggacatgctttcaacgtggagtttgatttttctcaggacaaagcagtgctcaagggaggacccctggatggcacttacagattgattcagtttcactttcactggggttcacttgatggacaaggttcagagcatactgtggataaaaagaaatatgctgcagaacttcacttggttcactggaacaccaaatatggggattttgggaaagctgtgcagcaacctgatggactggccgttctaggtatttttttgaaggttggcagcgctaaaccgggccttcagaaagttgttgatgtgctggattccattaaaacaaagggcaagagtgctgacttcactaacttcgatcctcgtggcctccttcctgaatccctggattactggacctacccaggctcactgaccacccctcctcttctggaatgtgtgacctggattgtgctcaaggaacccatcagcgtcagcagcgagcaggtgttgaaattccgtaaacttaacttcaatggggagggtgaacccgaagaactgatggtggacaactggcgcccagctcagtttctgaagaacaggcaaatcaaagcttccttcaaa

SEQ ID NO: 5679 - DNA, 777 bp, Artificial Sequence
  source: /note="Description of Artificial Sequence: Synthetic Destabilizing Domain (DD)"
tcccatcactgggggtacggcaaacacaacggacctgagcactggcataaggacttccccattgccaagggagagcgccagtcccctgttgacatcgacactcatacagccaagtatgacccttccctgaagcccctgtctgtttcctatgatcaagcaacttccctgaggatcctcaacaatggtcatgctttcaacgtggagtttgatttttctcaggacaaagcagtgctcaagggaggacccctggatggcacttacagattgattcagtttcactttcactggggttcacttgatggacaaggttcagagcatactgtggataaaaagaaatatgctgcagaacttcacttggttcactggaacaccaaatatggggattttgggaaagctgtgcagcaacctgatggactggccgttctaggtatttttttgaaggttggcagcgctaaaccgggccttcagaaagttgttgatgtgctggattccattaaaacaaagggcaagagtgctgacttcactaacttcgatcctcgtggcctccttcctgaatccctggattactggacctacccaggctcactgaccacccctcctcttctggaatgtgtgacctggattgtgctcaaggaacccatcagcgtcagcagcgagcaggtgttgaaattccgtaaacttaacttcaatggggagggtgaacccgaagaactgatggtggacaactggcgcccagctcagtttctgaagaacaggcaaatcaaagcttccttcaaa

SEQ ID NO: 5680 - protein, 259 aa, Artificial Sequence
  source: /note="Description of Artificial Sequence: Synthetic Destabilizing Domain (DD)"
SHHWGYGKHNGPEHWHKDFPIAKGERQSPVDIDTHTAKYDPSLKPLSVSYDNATSLRILYNGHAFNVEFDDSQDKAVLKGGPLDGTYRLIQFHFHWGSLDGQGSEHTVDKKKYAAELHLVHWNTKYGDFGKAVQQPDGLAVLGIFLKVGSAKPGLQKVVDVLDSIKTKGKSADFTNFDPRGLLPESLDYWTYPGSLTTPPLLECVTWIVLKEPISVSSEQVLKFRKLNFNGEGEPEELMVDNWRPAQPLKNRQIKASFK

SEQ ID NO: 5681 - DNA, 777 bp, Artificial Sequence
  source: /note="Description of Artificial Sequence: Synthetic Destabilizing Domain (DD)"
tcccatcactgggggtacggcaaacacaacggacctgagcactggcataaggacttccccattgccaagggagagcgccagtcccctgttgacatcgacactcatacagccaagtatgacccttccctgaagcccctgtctgtttcctatgataatgcaacttccctgaggatcctctataatggtcatgctttcaacgtggagtttgatgactctcaggacaaagcagtgctcaagggaggacccctggatggcacttacagattgattcagtttcactttcactggggttcacttgatggacaaggttcagagcatactgtggataaaaagaaatatgctgcagaacttcacttggttcactggaacaccaaatatggggattttgggaaagctgtgcagcaacctgatggactggccgttctaggtatttttttgaaggttggcagcgctaaaccgggccttcagaaagttgttgatgtgctggattccattaaaacaaagggcaagagtgctgacttcactaacttcgatcctcgtggcctccttcctgaatccctggattactggacctacccaggctcactgaccacccctcctcttctggaatgtgtgacctggattgtgctcaaggaacccatcagcgtcagcagcgagcaggtgttgaaattccgtaaacttaacttcaatggggagggtgaacccgaagaactgatggtggacaactggcgcccagctcagccactgaagaacaggcaaatcaaagcttccttcaaa

SEQ ID NO: 5682 - protein, 259 aa, Artificial Sequence
  source: /note="Description of Artificial Sequence: Synthetic Destabilizing Domain (DD)"
SHHWGYGKHNGPEHWHKDFPIAKGERQSPVDIDTHTAKYDPSLKPLSVSYDQATSLRILNNGHAFNVEFDDSQDKAVLKGGPLDGTYRLIQFHFHWGSLDGQGSDHTVDKKKYAAELHLVHWNTKYGDFGKAVQQPDGLAVLGIFLKVGSAKPGLQKVVDVLDSIKTKGKSADFTNFDPRGLLPESLDYWTYPGSLTTPPLLESVTWIVLKEPISVSSEQVLKFRKLNFNGEGEPEELMVDNWRPAQPLKNRQIKASFK

SEQ ID NO: 5683 - DNA, 777 bp, Artificial Sequence
  source: /note="Description of Artificial Sequence: Synthetic Destabilizing Domain (DD)"
tcccatcactgggggtacggcaaacacaacggacctgagcactggcataaggacttccccattgccaagggagagcgccagtcccctgttgacatcgacactcatacagccaagtatgacccttccctgaagcccctgtctgtttcctatgatcaagcaacttccctgagaatcctcaacaatggtcatgctttcaacgtggagtttgatgactctcaggacaaagcagtgctcaagggaggacccctggatggcacttacagattgattcagtttcactttcactggggttcacttgatggacaaggttcagaccatactgtggataaaaagaaatatgctgcagaacttcacttggttcactggaacaccaaatatggggattttgggaaagctgtgcagcaacctgatggactggccgttctaggtatttttttgaaggttggcagcgctaaaccgggccttcagaaagttgttgatgtgctggattccattaaaacaaagggcaagagtgctgacttcactaacttcgatcctcgtggcctccttcctgaatccctggattactggacctacccaggctcactgaccacccctcctcttctggaatctgtgacctggattgtgctcaaggaacccatcagcgtcagcagcgagcaggtgttgaaattccgtaaacttaacttcaatggggagggtgaacccgaagaactgatggtggacaactggcgcccagctcagccactgaagaacaggcaaatcaaagcttccttcaaa

SEQ ID NO: 5684 - protein, 259 aa, Artificial Sequence
  source: /note="Description of Artificial Sequence: Synthetic Destabilizing Domain (DD)"
SHHWGYGKHNGPEHWHKDFPIAKGERQSPVDIDTHTAKYDPSLKPLSVSYDQATSLRILNNGHAFNVEFDDSQDKAVLKGGPLDGTYRLIQFHFHWGSLDGQGSEHTVDKKKYAAELHLVHWNTKYGDFGKAVQQPDGLAVLGIFLKVGSAKPGLQKVVDVLDSIKTKGKSADFTNFDPRGLLPESLDYWTYPGSLTTPPLLESVTSIVLKEPISVSSEQVLKFRKLNFNGEGEPEELMVDNWRPAQPLKNRQIKASFK

SEQ ID NO: 5685 - DNA, 777 bp, Artificial Sequence
  source: /note="Description of Artificial Sequence: Synthetic Destabilizing Domain (DD)"
tcccatcactgggggtacggcaaacacaacggacctgagcactggcataaggacttccccattgccaagggagagcgccagtcccctgttgacatcgacactcatacagccaagtatgacccttccctgaagcccctgtctgtttcctatgatcaagcaacttccctgagaatcctcaacaatggtcatgctttcaacgtggagtttgatgactctcaggacaaagcagtgctcaagggaggacccctggatggcacttacagattgattcagtttcactttcactggggttcacttgatggacaaggttcagagcatactgtggataaaaagaaatatgctgcagaacttcacttggttcactggaacaccaaatatggggattttgggaaagctgtgcagcaacctgatggactggccgttctaggtatttttttgaaggttggcagcgctaaaccgggccttcagaaagttgttgatgtgctggattccattaaaacaaagggcaagagtgctgacttcactaacttcgatcctcgtggcctccttcctgaatccctggattactggacctacccaggctcactgaccacccctcctcttctggaatctgtgaccagcattgtgctcaaggaacccatcagcgtcagcagcgagcaggtgttgaaattccgtaaacttaacttcaatggggagggtgaacccgaagaactgatggtggacaactggcgcccagctcagccactgaagaacaggcaaatcaaagcttccttcaaa

SEQ ID NO: 5686 - protein, 259 aa, Artificial Sequence
  source: /note="Description of Artificial Sequence: Synthetic Destabilizing Domain (DD)"
SHHWGYGKHNGPEHWHKDFPIAKGERQSPVDIDTHTAKYDPSLKPLSVSYDQATSLRILNNGHAFNVEFDDSQDKAVLKGGPLDGTYRLIQFHFHWGSLDGQGSEHTVDKKKYAAELHLVHWNTKYGDFGKAVQQPDGLAVLGIFLKVGSAKPGLQKVVDVLDSIKTKGKSADFTNFDPRGLLPESLDYWTYPGSLTTPPLLESVTWIVLKEPISVSSEQVLKFRKLNFNGEGEPEELMVDNWRPAQPLKNRQIKASFK

SEQ ID NO: 5687 - DNA, 777 bp, Artificial Sequence
  source: /note="Description of Artificial Sequence: Synthetic Destabilizing Domain (DD)"
tcccatcactgggggtacggcaaacacaacggacctgagcactggcataaggacttccccattgccaagggagagcgccagtcccctgttgacatcgacactcatacagccaagtatgacccttccctgaagcccctgtctgtttcctatgatcaagcaacttccctgagaatcctcaacaatggtcatgctttcaacgtggagtttgatgactctcaggacaaagcagtgctcaagggaggacccctggatggcacttacagattgattcagtttcactttcactggggttcacttgatggacaaggttcagagcatactgtggataaaaagaaatatgctgcagaacttcacttggttcactggaacaccaaatatggggattttgggaaagctgtgcagcaacctgatggactggccgttctaggtatttttttgaaggttggcagcgctaaaccgggccttcagaaagttgttgatgtgctggattccattaaaacaaagggcaagagtgctgacttcactaacttcgatcctcgtggcctccttcctgaatccctggattactggacctacccaggctcactgaccacccctcctcttctggaatctgtgacctggattgtgctcaaggaacccatcagcgtcagcagcgagcaggtgttgaaattccgtaaacttaacttcaatggggagggtgaacccgaagaactgatggtggacaactggcgcccagctcagccactgaagaacaggcaaatcaaagcttccttcaaa

SEQ ID NO: 5688 - protein, 259 aa, Artificial Sequence
  source: /note="Description of Artificial Sequence: Synthetic Destabilizing Domain (DD)"
SHHWGYGKHNGPEHWHKDFPIAKGERQSPVDIDTHTAKYDPSLKPLSVSYDQATSLRILNNGHAFNVEFDDSQDKAVLKGGPLDGTYRLIQFHFHWGSLDGQGSEHTVDKKKYAAELHLVHWNTKYGDFGKAVQQPDGLAVLGIFLKVGSAKPGLQKVVDVLDSIKTKGKSADFTNFDPRGLLPESLDYWTIPGSLTTPPLLECVTWIVLKEPISVSSEQVLKFRKLNFNGEGEPEELMVDNWRPAQPLKNRQIKASFK

SEQ ID NO: 5689 - DNA, 777 bp, Artificial Sequence
  source: /note="Description of Artificial Sequence: Synthetic Destabilizing Domain (DD)"
tcccatcactgggggtacggcaaacacaacggacctgagcactggcataaggacttccccattgccaagggagagcgccagtcccctgttgacatcgacactcatacagccaagtatgacccttccctgaagcccctgtctgtttcctatgatcaagcaacttccctgaggatcctcaacaatggtcatgctttcaacgtggagtttgatgactctcaggacaaagcagtgctcaagggaggacccctggatggcacttacagattgattcagtttcactttcactggggttcacttgatggacaaggttcagagcatactgtggataaaaagaaatatgctgcagaacttcacttggttcactggaacaccaaatatggggattttgggaaagctgtgcagcaacctgatggactggccgttctaggtatttttttgaaggttggcagcgctaaaccgggccttcagaaagttgttgatgtgctggattccattaaaacaaagggcaagagtgctgacttcactaacttcgatcctcgtggcctccttcctgaatccctggattactggaccattccaggctcactgaccacccctcctcttctggaatgtgtgacctggattgtgctcaaggaacccatcagcgtcagcagcgagcaggtgttgaaattccgtaaacttaacttcaatggggagggtgaacccgaagaactgatggtggacaactggcgcccagctcagccactgaagaacaggcaaatcaaagcttccttcaaa

SEQ ID NO: 5690 - DNA, 777 bp, Artificial Sequence
  source: /note="Description of Artificial Sequence: Synthetic Destabilizing Domain (DD)"
tcccatcactgggggtacggcaaacacaacggacctgagcactggcataaggacttccccattgccaagggagagcgccagtcccctgttgacatcgacactcatacagccaagtatgacccttccctgaagcccctgtctgtttcctatgatcaagcaacttccctgaggatcctcaacaatggtcatgctttcaacgtggagtttgatgactctcaggacaaagcagtgctcaagggaggacccctggatggcacttacagattgattcagtttcactttcactggggttcacttgatggacaaggttcagagcatactgtggataaaaagaaatatgctgcagaacttcacttggttcactggaacaccaaatatggggattttgggaaagctgtgcagcaacctgatggactggccgttctaggtatttttttgaaggttggcagcgctaaaccgggccttcagaaagttgttgatgtgctggattccattaaaacaaagggcaagagtgctgacttcactaatttcgatcctcgtggcctccttcctgaatccctggattactggaccattccaggctcactgaccacccctcctcttctggaatgtgtgacctggattgtgctcaaggaacccatcagcgtcagcagcgagcaggtgttgaaattccgtaaacttaacttcaatggggagggtgaacccgaagaactgatggtggacaactggcgcccagctcagccactgaagaacaggcaaatcaaagcttccttcaaa

SEQ ID NO: 5691 - protein, 259 aa, Artificial Sequence
  source: /note="Description of Artificial Sequence: Synthetic Destabilizing Domain (DD)"
SHHWGYGKHNGPEHWHKDFPIAKGERQSPVDIDTHTAKYDPSLKPLSVSYDQATSLRILNNGHAFNVEFDDNQDKAVLKGGPLDGTYYLIQFHFHWGSLDGQGSEHTVDKKKYAAELHLVHWNTKYGDFGKAVQQPDGLAVLGIFLKVGSAKPGLQKVVDVLDSIKTKGKSADFTNFDPRGLLPESLDYWTYPGSLTTPPLLECVTWIVLKEPISVSSEQVLKFRKLNFNGEGEPEELMVDNWRPAQPLKNRQIKASFK

SEQ ID NO: 5692 - DNA, 777 bp, Artificial Sequence
  source: /note="Description of Artificial Sequence: Synthetic Destabilizing Domain (DD)"
tcccatcactgggggtacggcaaacacaacggacctgagcactggcataaggacttccccattgccaagggagagcgccagtcccctgttgacatcgacactcatacagccaagtatgacccttccctgaagcccctgtctgtttcctatgatcaagcaacttccctgaggatcctcaacaatggtcatgctttcaacgtggagtttgatgacaatcaggacaaagcagtgctcaagggaggacccctggatggcacttactatttgattcagtttcactttcactggggttcacttgatggacaaggttcagagcatactgtggataaaaagaaatatgctgcagaacttcacttggttcactggaacaccaaatatggggattttgggaaagctgtgcagcaacctgatggactggccgttctaggtatttttttgaaggttggcagcgctaaaccgggccttcagaaagttgttgatgtgctggattccattaaaacaaagggcaagagtgctgacttcactaacttcgatcctcgtggcctccttcctgaatccctggattactggacctacccaggctcactgaccacccctcctcttctggaatgtgtgacctggattgtgctcaaggaacccatcagcgtcagcagcgagcaggtgttgaaattccgtaaacttaacttcaatggggagggtgaacccgaagaactgatggtggacaactggcgcccagctcagccactgaagaacaggcaaatcaaagcttccttcaaa

SEQ ID NO: 5693 - protein, 259 aa, Artificial Sequence
  source: /note="Description of Artificial Sequence: Synthetic Destabilizing Domain (DD)"
SHHWGYGKHNGPEHWHKDFPIAKGERQSPVDIDTHTAKYDPSLKPLSVSYDQATSLRILNNGHAFNVEFKDSQDKAVLKGGPLDGTYRLIQFHFHWGSLDGQGSEHTVDKKKYAAELHLVHWNTKYGDFGKAVQQPDGLAVLGIFLKVGSAKPGLQKVVDVLDSIKTKGKSADFTNFDPRGLLPESLDYWFYPGSLTTPPLLECVTWIVLKEPISVSSEQVLKFRKLNFNGEGEPEELMVDNWRPAQPLKNRQIKASFK

SEQ ID NO: 5694 - DNA, 777 bp, Artificial Sequence
  source: /note="Description of Artificial Sequence: Synthetic Destabilizing Domain (DD)"
tcccatcactgggggtacggcaaacacaacggacctgagcactggcataaggacttccccattgccaagggagagcgccagtcccctgttgacatcgacactcatacagccaagtatgacccttccctgaagcccctgtctgtttcctatgatcaagcaacttccctgaggatcctcaacaatggtcatgctttcaacgtggagtttaaggactctcaggacaaagcagtgctcaagggaggacccctggatggcacttacagattgattcagtttcactttcactggggttcacttgatggacaaggttcagagcatactgtggataaaaagaaatatgctgcagaacttcacttggttcactggaacaccaaatatggggattttgggaaagctgtgcagcaacctgatggactggccgttctaggtatttttttgaaggttggcagcgctaaaccgggccttcagaaagttgttgatgtgctggattccattaaaacaaagggcaagagtgctgacttcactaacttcgatcctcgtggcctccttcctgaatccctggattactggttttacccaggctcactgaccacccctcctcttctggaatgtgtgacctggattgtgctcaaggaacccatcagcgtcagcagcgagcaggtgttgaaattccgtaaacttaacttcaatggggagggtgaacccgaagaactgatggtggacaactggcgcccagctcagccactgaagaacaggcaaatcaaagcttccttcaaa

SEQ ID NO: 5695 - protein, 236 aa, Artificial Sequence
  source: /note="Description of Artificial Sequence: Synthetic Destabilizing Domain (DD)"
SHHWGYGKHNGPEHWHKDFPIAKGERQSPVDIDTHTAKYDPSLKPLSVSYDQATSLRILNNGHAFNVEFDDSQDKAVLKGGPLDGTYRLIQFHFHWGSLDGQGSEHTVDKKKYAAELHLVHWNTKYGDFGKAVQQPDGLAVLGIFLKVGSAKPGLQKVVDVLDSIKTKGKSADFTNFDPRGLLPESLDYWTYPGSLTTPPLLECVTWIVLKEPISVSSEQVLKFRKLNFNGEGEPE

SEQ ID NO: 5696 - DNA, 777 bp, Artificial Sequence
  source: /note="Description of Artificial Sequence: Synthetic Destabilizing Domain (DD)"
tcccatcactgggggtacggcaaacacaacggacctgagcactggcataaggacttccccattgccaagggagagcgccagtcccctgttgacatcgacactcatacagccaagtatgacccttccctgaagcccctgtctgtttcctatgatcaagcaacttccctgaggatcctcaacaatggtcatgctttcaacgtggagtttgatgactctcaggacaaagcagtgctcaagggaggacccctggatggcacttacagattgattcagtttcactttcactggggttcacttgatggacaaggttcagagcatactgtggataaaaagaaatatgctgcagaacttcacttggttcactggaacaccaaatatggggattttgggaaagctgtgcagcaacctgatggactggccgttctaggtatttttttgaaggttggcagcgctaaaccgggccttcagaaagttgttgatgtgctggattccattaaaacaaagggcaagagtgctgacttcactaacttcgatcctcgtggcctccttcctgaatccctggattactggacctacccaggctcactgaccacccctcctcttctggaatgtgtgacctggattgtgctcaaggaacccatcagcgtcagcagcgagcaggtgttgaaattccgtaaacttaacttcaatggggagggtgaacccgaataactgatggtggacaactggcgcccagctcagccactgaagaacaggcaaatcaaagcttccttcaaa

SEQ ID NO: 5697 - protein, 259 aa, Artificial Sequence
  source: /note="Description of Artificial Sequence: Synthetic Destabilizing Domain (DD)"
SHHWGYGKHNGPEHWHKDFPIAKGERQSPVDIDTHTAKYDPSLKPLSVSYDQATSLRILNNGHAFNVEFDDSQDKAVLKGGPLDGTYRLIQFHFHWGSLDGQGSEHTVDKKKYAAELHLVHWNTKYGDFGKAVQQPDGLAVLDIFLKVGSAKPGLQKVVDVLDSIKTKGKSADFTNFDPRGLLPESLDYWTYPGSLTTPPLLECVTWIVLKEPISVSSEQVLKFRKLNFNGEGEPEELMVDNWRPAQPLKNRQIKASFK

SEQ ID NO: 5698 - DNA, 777 bp, Artificial Sequence
  source: /note="Description of Artificial Sequence: Synthetic Destabilizing Domain (DD)"
tcccatcactgggggtacggcaaacacaacggacctgagcactggcataaggacttccccattgccaagggagagcgccagtcccctgttgacatcgacactcatacagccaagtatgacccttccctgaagcccctgtctgtttcctatgatcaagcaacttccctgaggatcctcaacaatggtcatgctttcaacgtggagtttgatgactctcaggacaaagcagtgctcaagggaggacccctggatggcacttacagattgattcagtttcactttcactggggttcacttgatggacaaggttcagagcatactgtggataaaaagaaatatgctgcagaacttcacttggttcactggaacaccaaatatggggattttgggaaagctgtgcagcaacctgatggactggccgttctagatatttttttgaaggttggcagcgctaaaccgggccttcagaaagttgttgatgtgctggattccattaaaacaaagggcaagagtgctgacttcactaacttcgatcctcgtggcctccttcctgaatccctggattactggacctacccaggctcactgaccacccctcctcttctggaatgtgtgacctggattgtgctcaaggaacccatcagcgtcagcagcgagcaggtgttgaaattccgtaaacttaacttcaatggggagggtgaacccgaagaactgatggtggacaactggcgcccagctcagccactgaagaacaggcaaatcaaagcttccttcaaa

SEQ ID NO: 5699 - protein, 259 aa, Artificial Sequence
  source: /note="Description of Artificial Sequence: Synthetic Destabilizing Domain (DD)"
SHHWGYGKHNGPEHWHKDFPIAKGERQSPVDIDTHTAKYDPSLKPLSVSYDQATSLRILNNGHAFNVEFDDSQDKAVLKGGPLDGTYRLIQFHFHWGSLDGQGSEHTVDKKKYAAELHLVHWNTKYGDFGKAVQQPDGLAVLGIFLKVGSAKPGLQKVVDVLDSIKTKGKSADFTNFDPRGLLPESLDYWTLPGSLTTPPLLECVTWIVLKEPISVSSEQVLKFRKLNFNGEGEPEELMVDNWRPAQPLKNRQIKASFL

SEQ ID NO: 5700 - DNA, 777 bp, Artificial Sequence
  source: /note="Description of Artificial Sequence: Synthetic Destabilizing Domain (DD)"
tcccatcactgggggtacggcaaacacaacggacctgagcactggcataaggacttccccattgccaagggagagcgccagtcccctgttgacatcgacactcatacagccaagtatgacccttccctgaagcccctgtctgtttcctatgatcaagcaacttccctgaggatcctcaacaatggtcatgctttcaacgtggagtttgatgactctcaggacaaagcagtgctcaagggaggacccctggatggcacttacagattgattcagtttcactttcactggggttcacttgatggacaaggttcagagcatactgtggataaaaagaaatatgctgcagaacttcacttggttcactggaacaccaaatatggggattttgggaaagctgtgcagcaacctgatggactggccgttctaggtatttttttgaaggttggcagcgctaaaccgggccttcagaaagttgttgatgtgctggattccattaaaacaaagggcaagagtgctgacttcactaacttcgatcctcgtggcctccttcctgaatccctggattactggaccttgccaggctcactgaccacccctcctcttctggaatgtgtgacctggattgtgctcaaggaacccatcagcgtcagcagcgagcaggtgttgaaattccgtaaacttaacttcaatggggagggtgaacccgaagaactgatggtggacaactggcgcccagctcagccactgaagaacaggcaaatcaaagcttccttcttg

SEQ ID NO: 5701 - protein, 259 aa, Artificial Sequence
  source: /note="Description of Artificial Sequence: Synthetic Destabilizing Domain (DD)"
SHHWGYGKHNGPEHWHKDFPIAKGERQSPVDIDTHTAKYDPSLKPLSVSYDQATSLRILNNGHAFNVEFDDSQDKAVLKGGPLDGTYRLIQFHFHWGSLDGQGSEHTVDKKKYAAELHLVHWNTKYGDFGKAVQQPDGLAVLGIFLKVGSAKPGLQKVVDVLDSIKTKGKSADFTNFDPRGLLPESLDYWTYPGSLTTPPLLECMTWIVLKEPISVSSEQVLKFRKLNFNGEGEPEELMVDNWRPAQPLKNRQIKASFK

SEQ ID NO: 5702 - DNA, 777 bp, Artificial Sequence
  source: /note="Description of Artificial Sequence: Synthetic Destabilizing Domain (DD)"
tcccatcactgggggtacggcaaacacaacggacctgagcactggcataaggacttccccattgccaagggagagcgccagtcccctgttgacatcgacactcatacagccaagtatgacccttccctgaagcccctgtctgtttcctatgatcaagcaacttccctgaggatcctcaacaatggtcatgctttcaacgtggagtttgatgactctcaggacaaagcagtgctcaagggaggacccctggatggcacttacagattgattcagtttcactttcactggggttcacttgatggacaaggttcagagcatactgtggataaaaagaaatatgctgcagaacttcacttggttcactggaacaccaaatatggggattttgggaaagctgtgcagcaacctgatggactggccgttctaggtatttttttgaaggttggcagcgctaaaccgggccttcagaaagttgttgatgtgctggattccattaaaacaaagggcaagagtgctgacttcactaacttcgatcctcgtggcctccttcctgaatccctggattactggacctacccaggctcactgaccacccctcctcttctggaatgtatgacctggattgtgctcaaggaacccatcagcgtcagcagcgagcaggtgttgaaattccgtaaacttaacttcaatggggagggtgaacccgaagaactgatggtggacaactggcgcccagctcagccactgaagaacaggcaaatcaaagcttccttcaaa

SEQ ID NO: 5703 - protein, 259 aa, Artificial Sequence
  source: /note="Description of Artificial Sequence: Synthetic Destabilizing Domain (DD)"
SHHWGYGKHNGPEHWHKDFPIAKGERQSPVDIDTHTAKYDPSLKPLSVSYDQATSLRILNNGHAFNVEFFDSQDKAVLKGGPLDGTYRLIQFHFHWGSLDGQGSEHTVDKKKYAAELHLVHWNTKYGDFGKAVQQPDGLAVLGIFLKVGSAKPGLQKVVDVLDSIKTKGKSADFTNFDPRGLLPESLDYWTYPGSLTTPPLLECVTWIVLKEPISVSSEQVLKFRKLNFNGEGEPEELMFDNWRPAQLLKNRQIKASFK

SEQ ID NO: 5704 - DNA, 777 bp, Artificial Sequence
  source: /note="Description of Artificial Sequence: Synthetic Destabilizing Domain (DD)"
tcccatcactgggggtacggcaaacacaacggacctgagcactggcataaggacttccccattgccaagggagagcgccagtcccctgttgacatcgacactcatacagccaagtatgacccttccctgaagcccctgtctgtttcctatgatcaagcaacttccctgaggatcctcaacaatggtcatgctttcaacgtggagttttttgactctcaggacaaagcagtgctcaagggaggacccctggatggcacttacagattgattcagtttcactttcactggggttcacttgatggacaaggttcagagcatactgtggataaaaagaaatatgctgcagaacttcacttggttcactggaacaccaaatatggggattttgggaaagctgtgcagcaacctgatggactggccgttctaggtatttttttgaaggttggcagcgctaaaccgggccttcagaaagttgttgatgtgctggattccattaaaacaaagggcaagagtgctgacttcactaacttcgatcctcgtggcctccttcctgaatccctggattactggacctacccaggctcactgaccacccctcctcttctggaatgtgtgacctggattgtgctcaaggaacccatcagcgtcagcagcgagcaggtgttgaaattccgtaaacttaacttcaatggggagggtgaacccgaagaactgatgtttgacaactggcgcccagctcagttgctgaagaacaggcaaatcaaagcttccttcaaa

SEQ ID NO: 5705 - protein, 259 aa, Artificial Sequence
  source: /note="Description of Artificial Sequence: Synthetic Destabilizing Domain (DD)"
SHHWGYGKHNGPEHWHKDFPIAKGERQSPVDIDTHTAKYDPSLKPLSVSYDQATSLRILNNGHAFNVEFDDSQDKAVLKGGPLDGTYRLIQFHFHWGSLDGQGSEHTVDKKKYAAELHLVHWNTKYGDFGKAVQQPDGLAVLGIFLKVGSAKPGLQKVVDVLDSIKTKGKSADFTNFDPRGLLPESLDYWTFPGSLTTPPLLECVTWIVLKEPISVSSEQVLKFRKLNFNGEGEPEELMVDNWRPAQPLKNRQIKASFK

SEQ ID NO: 5706 - DNA, 777 bp, Artificial Sequence
  source: /note="Description of Artificial Sequence: Synthetic Destabilizing Domain (DD)"
tcccatcactgggggtacggcaaacacaacggacctgagcactggcataaggacttccccattgccaagggagagcgccagtcccctgttgacatcgacactcatacagccaagtatgacccttccctgaagcccctgtctgtttcctatgatcaagcaacttccctgaggatcctcaacaatggtcatgctttcaacgtggagtttgatgactctcaggacaaagcagtgctcaagggaggacccctggatggcacttacagattgattcagtttcactttcactggggttcacttgatggacaaggttcagagcatactgtggataaaaagaaatatgctgcagaacttcacttggttcactggaacaccaaatatggggattttgggaaagctgtgcagcaacctgatggactggccgttctaggtatttttttgaaggttggcagcgctaaaccgggccttcagaaagttgttgatgtgctggattccattaaaacaaagggcaagagtgctgacttcactaacttcgatcctcgtggcctccttcctgaatccctggattactggacctttccaggctcactgaccacccctcctcttctggaatgtgtgacctggattgtgctcaaggaacccatcagcgtcagcagcgagcaggtgttgaaattccgtaaacttaacttcaatggggagggtgaacccgaagaactgatggtggacaactggcgcccagctcagccactgaagaacaggcaaatcaaagcttccttcaaa

SEQ ID NO: 5707 - protein, 259 aa, Artificial Sequence
  source: /note="Description of Artificial Sequence: Synthetic Destabilizing Domain (DD)"
SHHWGYGKHNGPEHWHKDFPIAKGERQSPVDIDTHTAKYDPSLKPLSVSYDQATSLRILNNGHAFNVEFDDSQDKAVLKGGPLDGTYRLIQFHFHWGSLDGQGSEHTVDKKKYAAELHLVHWNTKYGDFGKAVQQPDGLAVLGIFFKVGSAKPGLQKVVDVLDSIKTKGKSADFTNFDPRGLLPESLDYWTYPGSLTTPPLLECVTWIVLKEPISVSSEQVLKFRKLNFNGEGEPEELMVDNWRPAFPLKNRQIKASFK

SEQ ID NO: 5708 - DNA, 777 bp, Artificial Sequence
  source: /note="Description of Artificial Sequence: Synthetic Destabilizing Domain (DD)"
tcccatcactgggggtacggcaaacacaacggacctgagcactggcataaggacttccccattgccaagggagagcgccagtcccctgttgacatcgacactcatacagccaagtatgacccttccctgaagcccctgtctgtttcctatgatcaagcaacttccctgaggatcctcaacaatggtcatgctttcaacgtggagtttgatgactctcaggacaaagcagtgctcaagggaggacccctggatggcacttacagattgattcagtttcactttcactggggttcacttgatggacaaggttcagagcatactgtggataaaaagaaatatgctgcagaacttcacttggttcactggaacaccaaatatggggattttgggaaagctgtgcagcaacctgatggactggccgttctaggtattttttttaaggttggcagcgctaaaccgggccttcagaaagttgttgatgtgctggattccattaaaacaaagggcaagagtgctgacttcactaacttcgatcctcgtggcctccttcctgaatccctggattactggacctacccaggctcactgaccacccctcctcttctggaatgtgtgacctggattgtgctcaaggaacccatcagcgtcagcagcgagcaggtgttgaaattccgtaaacttaacttcaatggggagggtgaacccgaagaactgatggtggacaactggcgcccagcttttccactgaagaacaggcaaatcaaagcttccttcaaa

SEQ ID NO: 5709 - protein, 259 aa, Artificial Sequence
  source: /note="Description of Artificial Sequence: Synthetic Destabilizing Domain (DD)"
SHHWGYGKHNGPEHWHKDFPIAKGERQSPVDIDTHTAKYDPSLKPLSVSYIQATSLRILNNGHAFNVEFDDSQDKAVLKGGPLDGTYRLIQFHFHWGSLDGQGSEHTVDKKKYAAELHLVHWNTKYGDFGKAVQQPDGLAVLGIFLKVGSAKPGLQKVVDVLDSIKTKGKSADFTNFDPRGLLPESLDYWTYPGSLTTPPLLECVTWIVLKEPISVSSEQVLKFRKLNFNGEGEPEELMVDNWRPAQPLKNRQIKAPFK

SEQ ID NO: 5710 - DNA, 777 bp, Artificial Sequence
  source: /note="Description of Artificial Sequence: Synthetic Destabilizing Domain (DD)"
tcccatcactgggggtacggcaaacacaacggacctgagcactggcataaggacttccccattgccaagggagagcgccagtcccctgttgacatcgacactcatacagccaagtatgacccttccctgaagcccctgtctgtttcctatattcaagcaacttccctgaggatcctcaacaatggtcatgctttcaacgtggagtttgatgactctcaggacaaagcagtgctcaagggaggacccctggatggcacttacagattgattcagtttcactttcactggggttcacttgatggacaaggttcagagcatactgtggataaaaagaaatatgctgcagaacttcacttggttcactggaacaccaaatatggggattttgggaaagctgtgcagcaacctgatggactggccgttctaggtatttttttgaaggttggcagcgctaaaccgggccttcagaaagttgttgatgtgctggattccattaaaacaaagggcaagagtgctgacttcactaacttcgatcctcgtggcctccttcctgaatccctggattactggacctacccaggctcactgaccacccctcctcttctggaatgtgtgacctggattgtgctcaaggaacccatcagcgtcagcagcgagcaggtgttgaaattccgtaaacttaacttcaatggggagggtgaacccgaagaactgatggtggacaactggcgcccagctcagccactgaagaacaggcaaatcaaagctcccttcaaa

SEQ ID NO: 5711 - protein, 259 aa, Artificial Sequence
  source: /note="Description of Artificial Sequence: Synthetic Destabilizing Domain (DD)"
SHHWGYGKHNGPEHWHKDFPIAKGERQSPVDIDTHTAKYDPSLKPLSVSYDQATSLRILNNGHAFNVEFDSSQDKAVLKGGPLDGTYRLIQFHFHWGSLDGQGSEHTVDKKKYAAELHLVHWNTKYGDFGKAVQQPDGLAVLGIFLKVGSAKPGLQKVVDVLDSIKTKGKSADFTNFDPRGLLPESLDYWNYPGSLTTPPLLECVTWIVLKEPISVSSEQVLKFRKLNFNGEGEPEELMVDNWRPAQPLKNRQIKASFK

SEQ ID NO: 5712 - DNA, 777 bp, Artificial Sequence
  source: /note="Description of Artificial Sequence: Synthetic Destabilizing Domain (DD)"
tcccatcactgggggtacggcaaacacaacggacctgagcactggcataaggacttccccattgccaagggagagcgccagtcccctgttgacatcgacactcatacagccaagtatgacccttccctgaagcccctgtctgtttcctatgatcaagcaacttccctgaggatcctcaacaatggtcatgctttcaacgtggagtttgatagttctcaggacaaagcagtgctcaagggaggacccctggatggcacttacagattgattcagtttcactttcactggggttcacttgatggacaaggttcagagcatactgtggataaaaagaaatatgctgcagaacttcacttggttcactggaacaccaaatatggggattttgggaaagctgtgcagcaacctgatggactggccgttctaggtatttttttgaaggttggcagcgctaaaccgggccttcagaaagttgttgatgtgctggattccattaaaacaaagggcaagagtgctgacttcactaacttcgatcctcgtggcctccttcctgaatccctggattactggaattacccaggctcactgaccacccctcctcttctggaatgtgtgacctggattgtgctcaaggaacccatcagcgtcagcagcgagcaggtgttgaaattccgtaaacttaacttcaatggggagggtgaacccgaagaactgatggtggacaactggcgcccagctcagccactgaagaacaggcaaatcaaagcttccttcaaa

SEQ ID NO: 5713 - protein, 259 aa, Artificial Sequence
  source: /note="Description of Artificial Sequence: Synthetic Destabilizing Domain (DD)"
SHHWGYGKHNGPEHWHKDFPIAKGERQSPVDIDTHTAKYDPSLKPLSVSYDQATSLRILNNGHAFNVEFDDSQDKAVLKGGPLDGTYRLIQFHFHWGSLDGQGSEHTVDKKKYAAELHLVHWNTKYGDFGKAVQQPDGLAVLGIFLKVGSAKPGLQKVVDVLDSIKTKGKSADFTNFEPRGLLPESLDYWIYPGSLTTPPLLECVTWIVLKEPISVSSEQVLKFRKLNFNGEGEPEELMVDNWRPAQPLKNRQIKASFK

SEQ ID NO: 5714 - DNA, 777 bp, Artificial Sequence
  source: /note="Description of Artificial Sequence: Synthetic Destabilizing Domain (DD)"
tcccatcactgggggtacggcaaacacaacggacctgagcactggcataaggacttccccattgccaagggagagcgccagtcccctgttgacatcgacactcatacagccaagtatgacccttccctgaagcccctgtctgtttcctatgatcaagcaacttccctgaggatcctcaacaatggtcatgctttcaacgtggagtttgatgactctcaggacaaagcagtgctcaagggaggacccctggatggcacttacagattgattcagtttcactttcactggggttcacttgatggacaaggttcagagcatactgtggataaaaagaaatatgctgcagaacttcacttggttcactggaacaccaaatatggggattttgggaaagctgtgcagcaacctgatggactggccgttctaggtatttttttgaaggttggcagcgctaaaccgggccttcagaaagttgttgatgtgctggattccattaaaacaaagggcaagagtgctgacttcactaacttcgagcctcgtggcctccttcctgaatccctggattactggatttacccaggctcactgaccacccctcctcttctggaatgtgtgacctggattgtgctcaaggaacccatcagcgtcagcagcgagcaggtgttgaaattccgtaaacttaacttcaatggggagggtgaacccgaagaactgatggtggacaactggcgcccagctcagccactgaagaacaggcaaatcaaagcttccttcaaa

SEQ ID NO: 5715 - protein, 259 aa, Artificial Sequence
  source: /note="Description of Artificial Sequence: Synthetic Destabilizing Domain (DD)"
SHHWGYGKHNGPEHWHKDFPIAKGERQSPVDIDTHTAKYDPSLKPLSVSYDQATSLRILNNGHAFNVEFDDSQDKAVLKGGPLDGTYRLIQFHFHWGSLDGQGSEHTVDKKKYAAELHLVHWNTKYGDFGKAVQQPDGLAVLGIFLKVGSAKPGLQKVVDVLDSIKTKGKSADFTNFDPRGLLPESLDYWTLPGSLTTPPLLECVTWIVLKEPISVSSEQVLKFRKLNFNGEGEPEELMVDNWRPAQPLKNRQIKASFK

SEQ ID NO: 5716 - DNA, 777 bp, Artificial Sequence
  source: /note="Description of Artificial Sequence: Synthetic Destabilizing Domain (DD)"
tcccatcactgggggtacggcaaacacaacggacctgagcactggcataaggacttccccattgccaagggagagcgccagtcccctgttgacatcgacactcatacagccaagtatgacccttccctgaagcccctgtctgtttcctatgatcaagcaacttccctgaggatcctcaacaatggtcatgctttcaacgtggagtttgatgactctcaggacaaagcagtgctcaagggaggacccctggatggcacttacagattgattcagtttcactttcactggggttcacttgatggacaaggttcagagcatactgtggataaaaagaaatatgctgcagaacttcacttggttcactggaacaccaaatatggggattttgggaaagctgtgcagcaacctgatggactggccgttctaggtatttttttgaaggttggcagcgctaaaccgggccttcagaaagttgttgatgtgctggattccattaaaacaaagggcaagagtgctgacttcactaacttcgatcctcgtggcctccttcctgaatccctggattactggaccttgccaggctcactgaccacccctcctcttctggaatgtgtgacctggattgtgctcaaggaacccatcagcgtcagcagcgagcaggtgttgaaattccgtaaacttaacttcaatggggagggtgaacccgaagaactgatggtggacaactggcgcccagctcagccactgaagaacaggcaaatcaaagcttccttcaaa

SEQ ID NO: 5717 - protein, 259 aa, Artificial Sequence
  source: /note="Description of Artificial Sequence: Synthetic Destabilizing Domain (DD)"
SHHWGYGKHNGPEHWHKDFPIAKGERQSPVDIDTHTAKYDPSLKPLSVSYDQATNLRILNNGHAFNVEFDDSQDKAVLKGGPLDGTYRLIQFHFHWGSLDGKGSEHTVDKKKYAAELHLVHWNTKYGDFGKAVQQPDGLAVLGIFLKVGSAKPGLQKVVDVLDSIKTKGKSADFTNFDPRGLLPESLDYWTYPGSLTTPPLLECVTWIVLKEPISVSSEQVLKFRKLNFNGEGEPEELMVDNWRPAQPLKNRQIKASFK

SEQ ID NO: 5718 - DNA, 777 bp, Artificial Sequence
  source: /note="Description of Artificial Sequence: Synthetic Destabilizing Domain (DD)"
tcccatcactgggggtacggcaaacacaacggacctgagcactggcataaggacttccccattgccaagggagagcgccagtcccctgttgacatcgacactcatacagccaagtatgacccttccctgaagcccctgtctgtttcctatgatcaagcaactaatctgaggatcctcaacaatggtcatgctttcaacgtggagtttgatgactctcaggacaaagcagtgctcaagggaggacccctggatggcacttacagattgattcagtttcactttcactggggttcacttgatggaaagggttcagagcatactgtggataaaaagaaatatgctgcagaacttcacttggttcactggaacaccaaatatggggattttgggaaagctgtgcagcaacctgatggactggccgttctaggtatttttttgaaggttggcagcgctaaaccgggccttcagaaagttgttgatgtgctggattccattaaaacaaagggcaagagtgctgacttcactaacttcgatcctcgtggcctccttcctgaatccctggattactggacctacccaggctcactgaccacccctcctcttctggaatgtgtgacctggattgtgctcaaggaacccatcagcgtcagcagcgagcaggtgttgaaattccgtaaacttaacttcaatggggagggtgaacccgaagaactgatggtggacaactggcgcccagctcagccactgaagaacaggcaaatcaaagcttccttcaaa

SEQ ID NO: 5719 - protein, 259 aa, Artificial Sequence
  source: /note="Description of Artificial Sequence: Synthetic Destabilizing Domain (DD)"
SHHWGYGKHNGPEHWHKDFPIAKGERQSPVDIDTHTAKYDPSLKPLSVSYDQATSLRILNNGHAFNVEFYDSQDKAVLKGGPLDGTYRLIQFHFHWGSLDGQGSEHTVDKKKYAAELHLVHWNTKYGDFGKAVQQPDGLAVLGIFLKVGSAKPGLQKVVDVLDSIKTKGKSADFTNFDPRGLLPESLDYWTYPGSLTTPPLLECVTWIVLKEPISVSSEQVLKFRKLNFNGEGEPEELMVDNWRPALPLKNRQIKASFK

SEQ ID NO: 5720 - DNA, 777 bp, Artificial Sequence
  source: /note="Description of Artificial Sequence: Synthetic Destabilizing Domain (DD)"
tcccatcactgggggtacggcaaacacaacggacctgagcactggcataaggacttccccattgccaagggagagcgccagtcccctgttgacatcgacactcatacagccaagtatgacccttccctgaagcccctgtctgtttcctatgatcaagcaacttccctgaggatcctcaacaatggtcatgctttcaacgtggagttttatgactctcaggacaaagcagtgctcaagggaggacccctggatggcacttacagattgattcagtttcactttcactggggttcacttgatggacaaggttcagagcatactgtggataaaaagaaatatgctgcagaacttcacttggttcactggaacaccaaatatggggattttgggaaagctgtgcagcaacctgatggactggccgttctaggtatttttttgaaggttggcagcgctaaaccgggccttcagaaagttgttgatgtgctggattccattaaaacaaagggcaagagtgctgacttcactaacttcgatcctcgtggcctccttcctgaatccctggattactggacctacccaggctcactgaccacccctcctcttctggaatgtgtgacctggattgtgctcaaggaacccatcagcgtcagcagcgagcaggtgttgaaattccgtaaacttaacttcaatggggagggtgaacccgaagaactgatggtggacaactggcgcccagctcttccactgaagaacaggcaaatcaaagcttccttcaaa

SEQ ID NO: 5721 - protein, 259 aa, Artificial Sequence
  source: /note="Description of Artificial Sequence: Synthetic Destabilizing Domain (DD)"
SHHWGYGKHNGPEHWHKDFPIAKGERQSPVDIDTHTAKYDPSLKPLSVSYDQATSLRILNNGHAFNVEFDDNQDKAVLKGGPLDGTYFLIQFHFHWGSLDGQGSEHTVDKKKYAAELHLVHWNTKYGDFGKAVQQPDGLAVLGIFLKVGSAKPGLQKVVDVLDSIKTKGKSADFTNFDPRGLLPESLDYWTYPGSLTTPPLLECVTWIVLKEPISVSSEQVLKFRKLNFNGEGEPEELMVDNWRPAQPLKNRQIKASFK

SEQ ID NO: 5722 - DNA, 777 bp, Artificial Sequence
  source: /note="Description of Artificial Sequence: Synthetic Destabilizing Domain (DD)"
tcccatcactgggggtacggcaaacacaacggacctgagcactggcataaggacttccccattgccaagggagagcgccagtcccctgttgacatcgacactcatacagccaagtatgacccttccctgaagcccctgtctgtttcctatgatcaagcaacttccctgaggatcctcaacaatggtcatgctttcaacgtggagtttgatgacaatcaggacaaagcagtgctcaagggaggacccctggatggcacttactttttgattcagtttcactttcactggggttcacttgatggacaaggttcagagcatactgtggataaaaagaaatatgctgcagaacttcacttggttcactggaacaccaaatatggggattttgggaaagctgtgcagcaacctgatggactggccgttctaggtatttttttgaaggttggcagcgctaaaccgggccttcagaaagttgttgatgtgctggattccattaaaacaaagggcaagagtgctgacttcactaacttcgatcctcgtggcctccttcctgaatccctggattactggacctacccaggctcactgaccacccctcctcttctggaatgtgtgacctggattgtgctcaaggaacccatcagcgtcagcagcgagcaggtgttgaaattccgtaaacttaacttcaatggggagggtgaacccgaagaactgatggtggacaactggcgcccagctcagccactgaagaacaggcaaatcaaagcttccttcaaa

SEQ ID NO: 5723 - protein, 259 aa, Artificial Sequence
  source: /note="Description of Artificial Sequence: Synthetic Destabilizing Domain (DD)"
SHHWGYGKHNGPEHWHKDFPIAKGERQSPVDIDTHTAKYDPSLKPLSVSYDQATSLRILNNGHAFNVEFKDSQDKAVLKGGPLDGTYRLIQFHFHWGSLDGQGSEHTVDKKKYAAELHLVHWNTKYGDFGKAVQQPDGLAVLGIFLKVGSAKPGLQKVVDVLDSIKTKGKSADFTNFDPRGLLPESLDYWTYPGSLTTPPLLECVTWIVLKEPISVSSEQVLKFRKLNFLGEGGPEEFMVDNWRPAQPLKNRQIKASFK

SEQ ID NO: 5724 - DNA, 777 bp, Artificial Sequence
  source: /note="Description of Artificial Sequence: Synthetic Destabilizing Domain (DD)"
tcccatcactgggggtacggcaaacacaacggacctgagcactggcataaggacttccccattgccaagggagagcgccagtcccctgttgacatcgacactcatacagccaagtatgacccttccctgaagcccctgtctgtttcctatgatcaagcaacttccctgaggatcctcaacaatggtcatgctttcaacgtggagtttaaggactctcaggacaaagcagtgctcaagggaggacccctggatggcacttacagattgattcagtttcactttcactggggttcacttgatggacaaggttcagagcatactgtggataaaaagaaatatgctgcagaacttcacttggttcactggaacaccaaatatggggattttgggaaagctgtgcagcaacctgatggactggccgttctaggtatttttttgaaggttggcagcgctaaaccgggccttcagaaagttgttgatgtgctggattccattaaaacaaagggcaagagtgctgacttcactaacttcgatcctcgtggcctccttcctgaatccctggattactggacctacccaggctcactgaccacccctcctcttctggaatgtgtgacctggattgtgctcaaggaacccatcagcgtcagcagcgagcaggtgttgaaattccgtaaacttaacttccttggggagggtggacccgaagaatttatggtggacaactggcgcccagctcagccactgaagaacaggcaaatcaaagcttccttcaaa

SEQ ID NO: 5725 - protein, 259 aa, Artificial Sequence
  source: /note="Description of Artificial Sequence: Synthetic Destabilizing Domain (DD)"
SHHWGYGKHNGPEHWHKDFPIAKGERQSPVDIDTHTAKYDPSLKPLSVSYDQATSLRILNNGHAFNVEFFDSQDKAVLKGGPLDGTYRLIQFHFHWGSLDGQGSEHTVDKKKYAAELHLVHWNTKYGDFGKAVQQPDGLAVLGIFLKVGSAKPGLQKVVDVLDSIKTKGKSADFTNFDPRGLLPESLDYWTYPGSLTTPPLLECVTWIVLKEPISVSSEQVLKFRKLNFNGEGEPEELMVDNWRPAQPLKNRQIKASFK

SEQ ID NO: 5726 - DNA, 777 bp, Artificial Sequence
  source: /note="Description of Artificial Sequence: Synthetic Destabilizing Domain (DD)"
tcccatcactgggggtacggcaaacacaacggacctgagcactggcataaggacttccccattgccaagggagagcgccagtcccctgttgacatcgacactcatacagccaagtatgacccttccctgaagcccctgtctgtttcctatgatcaagcaacttccctgaggatcctcaacaatggtcatgctttcaacgtggagttttttgactctcaggacaaagcagtgctcaagggaggacccctggatggcacttacagattgattcagtttcactttcactggggttcacttgatggacaaggttcagagcatactgtggataaaaagaaatatgctgcagaacttcacttggttcactggaacaccaaatatggggattttgggaaagctgtgcagcaacctgatggactggccgttctaggtatttttttgaaggttggcagcgctaaaccgggccttcagaaagttgttgatgtgctggattccattaaaacaaagggcaagagtgctgacttcactaacttcgatcctcgtggcctccttcctgaatccctggattactggacctacccaggctcactgaccacccctcctcttctggaatgtgtgacctggattgtgctcaaggaacccatcagcgtcagcagcgagcaggtgttgaaattccgtaaacttaacttcaatggggagggtgaacccgaagaactgatggtggacaactggcgcccagctcagccactgaagaacaggcaaatcaaagcttccttcaaa

SEQ ID NO: 5727 - protein, 259 aa, Artificial Sequence
  source: /note="Description of Artificial Sequence: Synthetic Destabilizing Domain (DD)"
SHHWGYGKHNGPEHWHKDFPIAKGERQSPVDIDTHTAKYDPSLKPLSVSYDQATSLRILNNGHAFNVEFDFSQDKAVLKGGPLDGTYRLIQFHFHWGSLDGQGSEHTVDKKKYAAELHLVHWNTKYGDFGKAVQQPDGLAVLGIFLKVGSAKPGLQKVVDVLDSIKTKGKSADFTNFDPRGLLPESLDYWTYPGSLTTPPLLECVTWIVLKEPISVSSEQVLKFRKLNFNGEGEPEELMVDNWRPAQILKNRQIKASFK

SEQ ID NO: 5728 - DNA, 777 bp, Artificial Sequence
  source: /note="Description of Artificial Sequence: Synthetic Destabilizing Domain (DD)"
tcccatcactgggggtacggcaaacacaacggacctgagcactggcataaggacttccccattgccaagggagagcgccagtcccctgttgacatcgacactcatacagccaagtatgacccttccctgaagcccctgtctgtttcctatgatcaagcaacttccctgaggatcctcaacaatggtcatgctttcaacgtggagtttgatttttctcaggacaaagcagtgctcaagggaggacccctggatggcacttacagattgattcagtttcactttcactggggttcacttgatggacaaggttcagagcatactgtggataaaaagaaatatgctgcagaacttcacttggttcactggaacaccaaatatggggattttgggaaagctgtgcagcaacctgatggactggccgttctaggtatttttttgaaggttggcagcgctaaaccgggccttcagaaagttgttgatgtgctggattccattaaaacaaagggcaagagtgctgacttcactaacttcgatcctcgtggcctccttcctgaatccctggattactggacctacccaggctcactgaccacccctcctcttctggaatgtgtgacctggattgtgctcaaggaacccatcagcgtcagcagcgagcaggtgttgaaattccgtaaacttaacttcaatggggagggtgaacccgaagaactgatggtggacaactggcgcccagctcagattctgaagaacaggcaaatcaaagcttccttcaaa

SEQ ID NO: 5729 - protein, 259 aa, Artificial Sequence
  source: /note="Description of Artificial Sequence: Synthetic Destabilizing Domain (DD)"
SHHWGYGKHNGPEHWHKDFPIAKGERQSPVDIDTHTAKYDPSLKPLSVSYDQATSLRILNNGHAFNVEFDDSQDKAVLKGGPLDGTYRLIQFHFHWGSLDGQGSEHTVDKKKYAAELHLVHWNTKYGDFGKAVQQPDGLAVLGIFLKVGSAKPGLQKVVDVLDSIKTKGKSADFTNFDPRGLLPESLDYWNYPGSLTTPPLLECVTWIVLKEPISVSSEQVLKFRKLNFNGEGEPEELMVDNWRPAQPLKNRQIKASFK

SEQ ID NO: 5730 - DNA, 777 bp, Artificial Sequence
  source: /note="Description of Artificial Sequence: Synthetic Destabilizing Domain (DD)"
tcccatcactgggggtacggcaaacacaacggacctgagcactggcataaggacttccccattgccaagggagagcgccagtcccctgttgacatcgacactcatacagccaagtatgacccttccctgaagcccctgtctgtttcctatgatcaagcaacttccctgaggatcctcaacaatggtcatgctttcaacgtggagtttgatgactctcaggacaaagcagtgctcaagggaggacccctggatggcacttacagattgattcagtttcactttcactggggttcacttgatggacaaggttcagagcatactgtggataaaaagaaatatgctgcagaacttcacttggttcactggaacaccaaatatggggattttgggaaagctgtgcagcaacctgatggactggccgttctaggtatttttttgaaggttggcagcgctaaaccgggccttcagaaagttgttgatgtgctggattccattaaaacaaagggcaagagtgctgacttcactaacttcgatcctcgtggcctccttcctgaatccctggattactggaattacccaggctcactgaccacccctcctcttctggaatgtgtgacctggattgtgctcaaggaacccatcagcgtcagcagcgagcaggtgttgaaattccgtaaacttaacttcaatggggagggtgaacccgaagaactgatggtggacaactggcgcccagctcagccactgaagaacaggcaaatcaaagcttccttcaaa

SEQ ID NO: 5731 - protein, 259 aa, Artificial Sequence
  source: /note="Description of Artificial Sequence: Synthetic Destabilizing Domain (DD)"
  MOD_RES (71)..(71): Any amino acid
  MOD_RES (240)..(240): Any amino acid
  MOD_RES (248)..(248): Any amino acid
SHHWGYGKHNGPEHWHKDFPIAKGERQSPVDIDTHTAKYDPSLKPLSVSYDQATSLRILNNGHAFNVEFDXSQDKAVLKGGPLDGTYRLIQFHFHWGSLDGQGSEHTVDKKKYAAELHLVHWNTKYGDFGKAVQQPDGLAVLGIFLKVGSAKPGLQKVVDVLDSIKTKGKSADFTNFDPRGLLPESLDYWTYPGSLTTPPLLECVTWIVLKEPISVSSEQVLKFRKLNFNGEGEPEELMXDNWRPAQXLKNRQIKASFK

SEQ ID NO: 5732 - DNA, 777 bp, Artificial Sequence
  source: /note="Description of Artificial Sequence: Synthetic Destabilizing Domain (DD)"
tcccatcactgggggtacggcaaacacaacggacctgagcactggcataaggacttccccattgccaagggagagcgccagtcccctgttgacatcgacactcatacagccaagtatgacccttccctgaagcccctgtctgtttcctatgatcaagcaacttccctgaggatcctcaacaatggtcatgctttcaacgtggagtttgatkwytctcaggacaaagcagtgctcaagggaggacccctggatggcacttacagattgattcagtttcactttcactggggttcacttgatggacaaggttcagagcatactgtggataaaaagaaatatgctgcagaacttcacttggttcactggaacaccaaatatggggattttgggaaagctgtgcagcaacctgatggactggccgttctaggtatttttttgaaggttggcagcgctaaaccgggccttcagaaagttgttgatgtgctggattccattaaaacaaagggcaagagtgctgacttcactaacttcgatcctcgtggcctccttcctgaatccctggattactggacctacccaggctcactgaccacccctcctcttctggaatgtgtgacctggattgtgctcaaggaacccatcagcgtcagcagcgagcaggtgttgaaattccgtaaacttaacttcaatggggagggtgaacccgaagaactgatgktkgacaactggcgcccagctcagyyrctgaagaacaggcaaatcaaagcttccttcaaa

SEQ ID NO: 5733 - protein, 259 aa, Artificial Sequence
  source: /note="Description of Artificial Sequence: Synthetic Destabilizing Domain (DD)"
  MOD_RES (53)..(53): Any amino acid
  MOD_RES (55)..(56): Any amino acid
  MOD_RES (191)..(191): Any amino acid
SHHWGYGKHNGPEHWHKDFPIAKGERQSPVDIDTHTAKYDPSLKPLSVSYDQXTXXRILNNGHAFNVEFDDSQDKAVLKGGPLDGTYRLIQFHFHWGSLDGQGSEHTVDKKKYAAELHLVHWNTKYGDFGKAVQQPDGLAVLGIFLKVGSAKPGLQKVVDVLDSIKTKGKSADFTNFDPRGLLPESLDYWXYPGSLTTPPLLECVTWIVLKEPISVSSEQVLKFRKLNFNGEGEPEELMVDNWRPAQPLKNRQIKASFK

SEQ ID NO: 5734 - DNA, 777 bp, Artificial Sequence
  source: /note="Description of Artificial Sequence: Synthetic Destabilizing Domain (DD)"
tcccatcactgggggtacggcaaacacaacggacctgagcactggcataaggacttccccattgccaagggagagcgccagtcccctgttgacatcgacactcatacagccaagtatgacccttccctgaagcccctgtctgtttcctatgatcaagmaacttyyctraggatcctcaacaatggtcatgctttcaacgtggagtttgatgactctcaggacaaagcagtgctcaagggaggacccctggatggcacttacagattgattcagtttcactttcactggggttcacttgatggacaaggttcagagcatactgtggataaaaagaaatatgctgcagaacttcacttggttcactggaacaccaaatatggggattttgggaaagctgtgcagcaacctgatggactggccgttctaggtatttttttgaaggttggcagcgctaaaccgggccttcagaaagttgttgatgtgctggattccattaaaacaaagggcaagagtgctgacttcactaacttcgatcctcgtggcctccttcctgaatccctggattactggwyytacccaggctcactgaccacccctcctcttctggaatgtgtgacctggattgtgctcaaggaacccatcagcgtcagcagcgagcaggtgttgaaattccgtaaacttaacttcaatggggagggtgaacccgaagaactgatggtggacaactggcgcccagctcagccactgaagaacaggcaaatcaaagcttccttcaaa

SEQ ID NO: 5735 - protein, 259 aa, Artificial Sequence
  source: /note="Description of Artificial Sequence: Synthetic Destabilizing Domain (DD)"
SHHWGYGKHNGPEHWHKDFPIAKGERQSPVDIDTHTAKYDPSLKPLSVSYDQATSLRILNNGHAFNVEFDDSQDKAVLKGGPLDGTYRLIQFHFHWGSLDGQGSEHTVDKKKYAAELHLVHWNTKYGDFGKAVQQPDGLAVLGIFLKVGSAKPGLQKVVDVLDSIKTKGKSADFTNFDPRGLLPESLDYWTVPGSLTTPPLLECVTWIVLKEPISVSSEQVLKFRKLNFNGEGEPEELMVDNWRPAQPLKNRQIKASFF

SEQ ID NO: 5736 - DNA, 777 bp, Artificial Sequence
  source: /note="Description of Artificial Sequence: Synthetic Destabilizing Domain (DD)"
tcccatcactgggggtacggcaaacacaacggacctgagcactggcataaggacttccccattgccaagggagagcgccagtcccctgttgacatcgacactcatacagccaagtatgacccttccctgaagcccctgtctgtttcctatgatcaagcaacttccctgaggatcctcaacaatggtcatgctttcaacgtggagtttgatgactctcaggacaaagcagtgctcaagggaggacccctggatggcacttacagattgattcagtttcactttcactggggttcacttgatggacaaggttcagagcatactgtggataaaaagaaatatgctgcagaacttcacttggttcactggaacaccaaatatggggattttgggaaagctgtgcagcaacctgatggactggccgttctaggtatttttttgaaggttggcagcgctaaaccgggccttcagaaagttgttgatgtgctggattccattaaaacaaagggcaagagtgctgacttcactaacttcgatcctcgtggcctccttcctgaatccctggattactggaccgttccaggctcactgaccacccctcctcttctggaatgtgtgacctggattgtgctcaaggaacccatcagcgtcagcagcgagcaggtgttgaaattccgtaaacttaacttcaatggggagggtgaacccgaagaactgatggtggacaactggcgcccagctcagccactgaagaacaggcaaatcaaagcttccttcttt

SEQ ID NO: 5737 - protein, 259 aa, Artificial Sequence
  source: /note="Description of Artificial Sequence: Synthetic Destabilizing Domain (DD)"
SHHWGYGKHNGPEHWHKDFPIAKGERQSPVDIDTHTAKYDPSLKPLSVSYDQATSLRILNNDHAFNVEFDDSQDKAVLKGGPLDGTYRLIQFHFHWGSLDGQGSEHTVDKKKYAAELHLVHWNTKYGDFGKAVQQPDGLAVLGIFLKVGSAKPGLQKVVDVLDSIKTKGKSADFTNFDPRGLLPESLDYWTYPGSLTTPPLLECVTWIVLKEPISVSSEQVLKFRKLNFNGEGEPEELLVDNWRPAQPLKNRQIKASFK

SEQ ID NO: 5738 - DNA, 777 bp, Artificial Sequence
  source: /note="Description of Artificial Sequence: Synthetic Destabilizing Domain (DD)"
tcccatcactgggggtacggcaaacacaacggacctgagcactggcataaggacttccccattgccaagggagagcgccagtcccctgttgacatcgacactcatacagccaagtatgacccttccctgaagcccctgtctgtttcctatgatcaagcaacttccctgaggatcctcaacaatgatcatgctttcaacgtggagtttgatgactctcaggacaaagcagtgctcaagggaggacccctggatggcacttacagattgattcagtttcactttcactggggttcacttgatggacaaggttcagagcatactgtggataaaaaaaaatatgctgcagaacttcacttggttcactggaacaccaaatatggggattttgggaaagctgtgcagcaacctgatggactggccgttctaggtatttttttgaaggttggcagcgctaaaccgggccttcagaaagttgttgatgtgctggattccattaaaacaaagggcaagagtgctgacttcactaacttcgatcctcgtggcctccttcctgaatccctggattactggacctacccaggctcactgaccacccctcctcttctggaatgtgtgacctggattgtgctcaaggaacccatcagcgtcagcagcgagcaggtgttgaaattccgtaaacttaacttcaatggggagggtgaacccgaagaactgcttgtggacaactggcgcccagctcagccactgaagaacaggcaaatcaaagcttccttcaaa

SEQ ID NO: 5739 - protein, 259 aa, Artificial Sequence
  source: /note="Description of Artificial Sequence: Synthetic Destabilizing Domain (DD)"
SHHWGYGKHNGPEHWHKDFPIAKGERQSPVDIDTHTAKYDPSLKPLSVSYDQATSLRILNNGHAFNVEFDDSQDKAVLKGGPLDGTYRLIQFHFHWGSLDGQGSEHTVDKKKYAAELHLVHWNTKYGDFGKAFQQPDGLAVLGIFLKVGSAKPGLQKVVDVLDSIKTKGKSADFTNFDPRGLLPESLDYWTYPGSLTTPPLLECVTWIVLKEPISVSSEQVLKFRKFNFNGEGEPEELMVDNWRPAQPLKNRQIKASFK

SEQ ID NO: 5740 - DNA, 777 bp, Artificial Sequence
  source: /note="Description of Artificial Sequence: Synthetic Destabilizing Domain (DD)"
tcccatcactgggggtacggcaaacacaacggacctgagcactggcataaggacttccccattgccaagggagagcgccagtcccctgttgacatcgacactcatacagccaagtatgacccttccctgaagcccctgtctgtttcctatgatcaagcaacttccctgaggatcctcaacaatggtcatgctttcaacgtggagtttgatgactctcaggacaaagcagtgctcaagggaggacccctggatggcacttacagattgattcagtttcactttcactggggttcacttgatggacaaggttcagagcatactgtggataaaaagaaatatgctgcagaacttcacttggttcactggaacaccaaatatggggattttgggaaagcttttcagcaacctgatggactggccgttctaggtatttttttgaaggttggcagcgctaaaccgggccttcagaaagttgttgatgtgctggattccattaaaacaaagggcaagagtgctgacttcactaacttcgatcctcgtggcctccttcctgaatccctggattactggacctacccaggctcactgaccacccctcctcttctggaatgtgtgacctggattgtgctcaaggaacccatcagcgtcagcagcgagcaggtgttgaaattccgtaaatttaacttcaatggggagggtgaacccgaagaactgatggtggacaactggcgcccagctcagccactgaagaacaggcaaatcaaagcttccttcaaa

SEQ ID NO: 5741 - protein, 259 aa, Artificial Sequence
  source: /note="Description of Artificial Sequence: Synthetic Destabilizing Domain (DD)"
SHHWGYGKHNGPEHWHKDFPIAKGERQSPVDIDTHTAKYDPSLKPLSVSYDQATSLRILNNGHAFNVEFGDSQDKAVLKGGPLDGTYRLIQFHFHWGSLDGQGSEHTVDKKKYAAELHLVHWNTKYGDFGKAVQQPDGLAVLGIFLKVGSAKPGLQKVVDVLDSIKTKGKSADFTNFDPRGLLPESLDYWTYPGSLTTPPLLECVTWIVLKEPISVSSEQVLKFRKLNFKGEGEPEELMVDNWRPAQPLKNRQIKASFK

SEQ ID NO: 5742 - DNA, 777 bp, Artificial Sequence
  source: /note="Description of Artificial Sequence: Synthetic Destabilizing Domain (DD)"
tcccatcactgggggtacggcaaacacaacggacctgagcactggcataaggacttccccattgccaagggagagcgccagtcccctgttgacatcgacactcatacagccaagtatgacccttccctgaagcccctgtctgtttcctatgatcaagcaacttccctgaggatcctcaacaatggtcatgctttcaacgtggagtttggtgactctcaggacaaagcagtgctcaagggaggacccctggatggcacttacagattgattcagtttcactttcactggggttcacttgatggacaaggttcagagcatactgtggataaaaagaaatatgctgcagaacttcacttggttcactggaacaccaaatatggggattttgggaaagctgtgcagcaacctgatggactggccgttctaggtatttttttgaaggttggcagcgctaaaccgggccttcagaaagttgttgatgtgctggattccattaaaacaaagggcaagagtgctgacttcactaacttcgatcctcgtggcctccttcctgaatccctggattactggacctacccaggctcactgaccacccctcctcttctggaatgtgtgacctggattgtgctcaaggaacccatcagcgtcagcagcgagcaggtgttgaaattccgtaaacttaacttcaagggggagggtgaacccgaagaactgatggtggacaactggcgcccagctcagccactgaagaacaggcaaatcaaagcttccttcaaa

SEQ ID NO: 5743 - protein, 259 aa, Artificial Sequence
  source: /note="Description of Artificial Sequence: Synthetic Destabilizing Domain (DD)"
SHHWGYGKHNGPEHWHKDFPIAKGERQSPVDIDTHTAKYDPSLKPLSVSYDQATFLRILNNGHAFNVEFSDSQDKAVLKGGPLDGTYRLIQFHFHWGSLDGQGSEHTVDKKKYAAELHLVHWNTKYGDFGKAVQQPDGLAVLGIFLKVGSAKPGLQKVVDVLDSIKTKGKSADFTNFDPRGLLPESLDYWTYPGSLTTPPLLECVTWIVLKEPISVSSEQVLKFRKLNFNGEGEPEELMVDNWRPAQPLKNRQIKASFK

SEQ ID NO: 5744 - DNA, 777 bp, Artificial Sequence
  source: /note="Description of Artificial Sequence: Synthetic Destabilizing Domain (DD)"
tcccatcactgggggtacggcaaacacaacggacctgagcactggcataaggacttccccattgccaagggagagcgccagtcccctgttgacatcgacactcatacagccaagtatgacccttccctgaagcccctgtctgtttcctatgatcaagcaacttttctgaggatcctcaacaatggtcatgctttcaacgtggagtttagtgactctcaggacaaagcagtgctcaagggaggacccctggatggcacttacagattgattcagtttcactttcactggggttcacttgatggacaaggttcagagcatactgtggataaaaagaaatatgctgcagaacttcacttggttcactggaacaccaaatatggggattttgggaaagctgtgcagcaacctgatggactggccgttctaggtatttttttgaaggttggcagcgctaaaccgggccttcagaaagttgttgatgtgctggattccattaaaacaaagggcaagagtgctgacttcactaacttcgatcctcgtggcctccttcctgaatccctggattactggacctacccaggctcactgaccacccctcctcttctggaatgtgtgacctggattgtgctcaaggaacccatcagcgtcagcagcgagcaggtgttgaaattccgtaaacttaacttcaatggggagggtgaacccgaagaactgatggtggacaactggcgcccagctcagccactgaagaacaggcaaatcaaagcttccttcaaa

SEQ ID NO: 5745 - protein, 259 aa, Artificial Sequence
  source: /note="Description of Artificial Sequence: Synthetic Destabilizing Domain (DD)"
SHHWGYGKHNGPEHWHKDFPIAKGERQSPVDIDTHTAKYDPSLKPLSVSYLQATSLRILNNGHAFNVEFDDSQDKAVLKGGPLDGTYRLIQFHFHWGSLDGQGSEHTVDKKKYAAELHLVHWNTKYRDFGKAVQQPDGLAVLGIFLKVGSAKPGLQKVVDVLDSIKTKGKSADFTNFDPRGLLPESLDYWTYPGSLTTPPLLECVTWIVLKEPISVSSEQVLKFRKLNFNGEGEPEELMVDNWRPAFPLKNRQIKASFK

SEQ ID NO: 5746 - DNA, 777 bp, Artificial Sequence
  source: /note="Description of Artificial Sequence: Synthetic Destabilizing Domain (DD)"
tcccatcactgggggtacggcaaacacaacggacctgagcactggcataaggacttccccattgccaagggagagcgccagtcccctgttgacatcgacactcatacagccaagtatgacccttccctgaagcccctgtctgtttcctatctgcaagcaacttccctgaggatcctcaacaatggtcatgctttcaacgtggagtttgatgactctcaggacaaagcagtgctcaagggaggacccctggatggcacttacagattgattcagtttcactttcactggggttcacttgatggacaaggttcagagcatactgtggataaaaagaaatatgctgcagaacttcacttggttcactggaacaccaaatatagagattttgggaaagctgtgcagcaacctgatggactggccgttctaggtatttttttgaaggttggcagcgctaaaccgggccttcagaaagttgttgatgtgctggattccattaaaacaaagggcaagagtgctgacttcactaacttcgatcctcgtggcctccttcctgaatccctggattactggacctacccaggctcactgaccacccctcctcttctggaatgtgtgacctggattgtgctcaaggaacccatcagcgtcagcagcgagcaggtgttaaaattccgtaaacttaacttcaatggggagggtgaacccgaagaactgatggtggacaactggcgcccagcttttccactgaagaacaggcaaatcaaagcttccttcaaa

SEQ ID NO: 5747 - protein, 259 aa, Artificial Sequence
  source: /note="Description of Artificial Sequence: Synthetic Destabilizing Domain (DD)"
  MOD_RES (72)..(72): Any amino acid
  MOD_RES (88)..(88): Any amino acid
SHHWGYGKHNGPEHWHKDFPIAKGERQSPVDIDTHTAKYDPSLKPLSVSYDQATSLRILNNGHAFNVEFDDXQDKAVLKGGPLDGTYXLIQFHFHWGSLDGQGSEHTVDKKKYAAELHLVHWNTKYGDFGKAVQQPDGLAVLGIFLKVGSAKPGLQKVVDVLDSIKTKGKSADFTNFDPRGLLPESLDYWTYPGSLTTPPLLECVTWIVLKEPISVSSEQVLKFRKLNFNGEGEPEELMVDNWRPAQPLKNRQIKASFK

SEQ ID NO: 5748 - DNA, 777 bp, Artificial Sequence
  source: /note="Description of Artificial Sequence: Synthetic Destabilizing Domain (DD)"
tcccatcactgggggtacggcaaacacaacggacctgagcactggcataaggacttccccattgccaagggagagcgccagtcccctgttgacatcgacactcatacagccaagtatgacccttccctgaagcccctgtctgtttcctatgatcaagcaacttccctgaggatcctcaacaatggtcatgctttcaacgtggagtttgatgacwmtcaggacaaagcagtgctcaagggaggacccctggatggcacttacttwttgattcagtttcactttcactggggttcacttgatggacaaggttcagagcatactgtggataaaaagaaatatgctgcagaacttcacttggttcactggaacaccaaatatggggattttgggaaagctgtgcagcaacctgatggactggccgttctaggtatttttttgaaggttggcagcgctaaaccgggccttcagaaagttgttgatgtgctggattccattaaaacaaagggcaagagtgctgacttcactaacttcgatcctcgtggcctccttcctgaatccctggattactggacctacccaggctcactgaccacccctcctcttctggaatgtgtgacctggattgtgctcaaggaacccatcagcgtcagcagcgagcaggtgttgaaattccgtaaacttaacttcaatggggagggtgaacccgaagaactgatggtggacaactggcgcccagctcagccactgaagaacaggcaaatcaaagcttccttcaaa

SEQ ID NO: 5749 - protein, 259 aa, Artificial Sequence
  source: /note="Description of Artificial Sequence: Synthetic Destabilizing Domain (DD)"
  MOD_RES (192)..(192): Any amino acid
SHHWGYGKHNGPEHWHKDFPIAKGERQSPVDIDTHTAKYDPSLKPLSVSYDQATSLRILNNGHAFNVEFDDSQDKAVLKGGPLDGTYRLIQFHFHWGSLDGQGSEHTVDKKKYAAELHLVHWNTKYGDFGKAVQQPDGLAVLGIFLKVGSAKPGLQKVVDVLDSIKTKGKSADFTNFDPRGLLPESLDYWTXPGSLTTPPLLECVTWIVLKEPISVSSEQVLKFRKLNFNGEGEPEELMVDNWRPAQPLKNRQIKASFK

SEQ ID NO: 5750 - DNA, 777 bp, Artificial Sequence
  source: /note="Description of Artificial Sequence: Synthetic Destabilizing Domain (DD)"
tcccatcactgggggtacggcaaacacaacggacctgagcactggcataaggacttccccattgccaagggagagcgccagtcccctgttgacatcgacactcatacagccaagtatgacccttccctgaagcccctgtctgtttcctatgatcaagcaacttccctgaggatcctcaacaatggtcatgctttcaacgtggagtttgatgactctcaggacaaagcagtgctcaagggaggacccctggatggcacttacagattgattcagtttcactttcactggggttcacttgatggacaaggttcagagcatactgtggataaaaagaaatatgctgcagaacttcacttggttcactggaacaccaaatatggggattttgggaaagctgtgcagcaacctgatggactggccgttctaggtatttttttgaaggttggcagcgctaaaccgggccttcagaaagttgttgatgtgctggattccattaaaacaaagggcaagagtgctgacttcactaacttcgatcctcgtggcctccttcctgaatccctggattactggaccwwyccaggctcactgaccacccctcctcttctggaatgtgtgacctggattgtgctcaaggaacccatcagcgtcagcagcgagcaggtgttgaaattccgtaaacttaacttcaatggggagggtgaacccgaagaactgatggtggacaactggcgcccagctcagccactgaagaacaggcaaatcaaagcttccttcaaa

SEQ ID NO: 5751 - protein, 259 aa, Artificial Sequence
  source: /note="Description of Artificial Sequence: Synthetic Destabilizing Domain (DD)"
  MOD_RES (50)..(50): Any amino acid
  MOD_RES (71)..(71): Any amino acid
  MOD_RES (240)..(240): Any amino acid
  MOD_RES (248)..(248): Any amino acid
SHHWGYGKHNGPEHWHKDFPIAKGERQSPVDIDTHTAKYDPSLKPLSVSXDQATSLRILNNGHAFNVEFDXSQDKAVLKGGPLDGTYRLIQFHFHWGSLDGQGSEHTVDKKKYAAELHLVHWNTKYGDFGKAVQQPDGLAVLGIFLKVGSAKPGLQKVVDVLDSIKTKGKSADFTNFDPRGLLPESLDYWTYPGSLTTPPLLECVTWIVLKEPISVSSEQVLKFRKLNFNGEGEPEELMXDNWRPAQXLKNRQIKASFK

SEQ ID NO: 5752 - DNA, 777 bp, Artificial Sequence
  source: /note="Description of Artificial Sequence: Synthetic Destabilizing Domain (DD)"
tcccatcactgggggtacggcaaacacaacggacctgagcactggcataaggacttccccattgccaagggagagcgccagtcccctgttgacatcgacactcatacagccaagtatgacccttccctgaagcccctgtctgtttccwmtgatcaagcaacttccctgaggatcctcaacaatggtcatgctttcaacgtggagtttgatkwytctcaggacaaagcagtgctcaagggaggacccctggatggcacttacagattgattcagtttcactttcactggggttcacttgatggacaaggttcagagcatactgtggataaaaagaaatatgctgcagaacttcacttggttcactggaacaccaaatatggggattttgggaaagctgtgcagcaacctgatggactggccgttctaggtatttttttgaaggttggcagcgctaaaccgggccttcagaaagttgttgatgtgctggattccattaaaacaaagggcaagagtgctgacttcactaacttcgatcctcgtggcctccttcctgaatccctggattactggacctacccaggctcactgaccacccctcctcttctggaatgtgtgacctggattgtgctcaaggaacccatcagcgtcagcagcgagcaggtgttgaaattccgtaaacttaacttcaatggggagggtgaacccgaagaactgatgktkgacaactggcgcccagctcagyyactgaagaacaggcaaatcaaagcttccttcaaa

SEQ ID NO: 5753 - protein, 259 aa, Artificial Sequence
  source: /note="Description of Artificial Sequence: Synthetic Destabilizing Domain (DD)"
SHHWGYGKHNGPEHWHKDFPIAKGERQSPVDIDTHTAKYDPSLKPLSVSYDQATSLRILNNGHAFNVEFDISQDKAVLKGGPLDGTYRLIQFHFHCGSLDGQGSEHTVDKKKYAAELHLVHWNTKYGDFGKAVQQPDGLAVLGIFLKVGSAKPGLQKVVDVLDSIKTKGKSADFTNFDPRGLLPESLDYWTYPGSLTTPPLLECVTWIVLKEPISVSSEQVLKFRKLNFNGEGEPEELMVDNWRPAQPLKNRQIKASFK

SEQ ID NO: 5754 - DNA, 777 bp, Artificial Sequence
  source: /note="Description of Artificial Sequence: Synthetic Destabilizing Domain (DD)"
tcccatcactgggggtacggcaaacacaacggacctgagcactggcataaggacttccccattgccaagggagagcgccagtcccctgttgacatcgacactcatacagccaagtatgacccttccctgaagcccctgtctgtttcctatgatcaagcaacttccctgaggatcctcaacaatggtcatgctttcaacgtggagtttgatatttctcaggacaaagcagtgctcaagggaggacccctggatggcacttacagattgattcagtttcactttcactgcggttcacttgatggacaaggttcagagcatactgtggataaaaagaaatatgctgcagaacttcacttggttcactggaacaccaaatatggggattttgggaaagctgtgcagcaacctgatggactggccgttctaggtatttttttgaaggttggcagcgctaaaccgggccttcagaaagttgttgatgtgctggattccattaaaacaaagggcaagagtgctgacttcactaacttcgatcctcgtggcctccttcctgaatccctggattactggacctacccaggctcactgaccacccctcctcttctggaatgtgtgacctggattgtgctcaaggaacccatcagcgtcagcagcgagcaggtgttgaaattccgtaaacttaacttcaatggggagggtgaacccgaagaactgatggtggacaactggcgcccagctcagccactgaagaacaggcaaatcaaagcttccttcaaa

SEQ ID NO: 5755 - protein, 259 aa, Artificial Sequence
  source: /note="Description of Artificial Sequence: Synthetic Destabilizing Domain (DD)"
SHHWGYGKHNGPEHWHKDFPIAKGERQSPVDIDTHTAKYDPSLKPLSVSYDQATSLRILNNGHAFNVEFKDSQDKAVLKGGPLDGTYRLIQFHFHWGSLDGQGSEHTVDKKKYAAELHLVHWNTKYGDFGKAVQQPDGLAVLGIFLKVGSAKPGLQKVVDVLDSIKTKGKSADFTNFDPRGLLPESLDYWFYPGSLTTPPLLECVTWIVLKEPISVSSEQVLKFRKLNFFGEGEPEELMVDNWRPAQPLKNRQIKASFK

SEQ ID NO: 5756 - DNA, 777 bp, Artificial Sequence
  source: /note="Description of Artificial Sequence: Synthetic Destabilizing Domain (DD)"
tcccatcactgggggtacggcaaacacaacggacctgagcactggcataaggacttccccattgccaagggagagcgccagtcccctgttgacatcgacactcatacagccaagtatgacccttccctgaagcccctgtctgtttcctatgatcaagcaacttccctgaggatcctcaacaatggtcatgctttcaacgtggagtttaaggactctcaggacaaagcagtgctcaagggaggacccctggatggcacttacagattgattcagtttcactttcactggggttcacttgatggacaaggttcagagcatactgtggataaaaagaaatatgctgcagaacttcacttggttcactggaacaccaaatatggggattttgggaaagctgtgcagcaacctgatggactggccgttctaggtatttttttgaaggttggcagcgctaaaccgggccttcagaaagttgttgatgtgctggattccattaaaacaaagggcaagagtgctgacttcactaacttcgatcctcgtggcctccttcctgaatccctggattactggttttacccaggctcactgaccacccctcctcttctggaatgtgtgacctggattgtgctcaaggaacccatcagcgtcagcagcgagcaggtgttgaaattccgtaaacttaacttctttggggagggtgaacccgaagaactgatggtggacaactggcgcccagctcagccactgaagaacaggcaaatcaaagcttccttcaaa

SEQ ID NO: 5757 - protein, 259 aa, Artificial Sequence
  source: /note="Description of Artificial Sequence: Synthetic Destabilizing Domain (DD)"
SHHWGYGKHNGPEHWHKDFPIAKGERQSPVDIDTHTAKYDPSLKPLSVSYDQATSLRNLNNGHAFNVEFDDSQDKAVLKGGPLDGTYRLIQFHFHWGSLDRQGSEHTVDKKKYAAELHLVHWNTKYGDFGKAVQQPDGLAVLGIFLKVGSAKPGLQKVVDVLDSIKTKGKSADFTNFDPRGLLPESLDYWTYPGSLTTPPLLECVTWIVLKEPISVSSEQVLKFRKLNFNGEGEPEELMVDNWRPAQPLKNRQIKASFK

SEQ ID NO: 5758 - DNA, 777 bp, Artificial Sequence
  source: /note="Description of Artificial Sequence: Synthetic Destabilizing Domain (DD)"
tcccatcactgggggtacggcaaacacaacggacctgagcactggcataaggacttccccattgccaagggagagcgccagtcccctgttgacatcgacactcatacagccaagtatgacccttccctgaagcccctgtctgtttcctatgatcaagcaacttccctgagaaacctcaacaatggtcatgctttcaacgtggagtttgatgactctcaggacaaagcagtgctcaagggaggacccctggatggcacttacagattgattcagtttcactttcactggggttcacttgatcgacaaggttcagagcatactgtggataaaaagaaatatgctgcagaacttcacttggttcactggaacaccaaatatggggattttgggaaagctgtgcagcaacctgatggactggccgttctaggtatttttttgaaggttggcagcgctaaaccgggccttcagaaagttgttgatgtgctggattccattaaaacaaagggcaagagtgctgacttcactaacttcgatcctcgtggcctccttcctgaatccctggattactggacctacccaggctcactgaccacccctcctcttctggaatgtgtgacctggattgtgctcaaggaacccatcagcgtcagcagcgagcaggtgttgaaattccgtaaacttaacttcaatggggagggtgaacccgaagaactgatggtggacaactggcgcccagctcagccactgaagaacaggcaaatcaaagcttccttcaaa

SEQ ID NO: 5759 - protein, 259 aa, Artificial Sequence
  source: /note="Description of Artificial Sequence: Synthetic Destabilizing Domain (DD)"
SHHWGYGKHNGPEHWHKDFPIAKGERQSPVDIDTHTAKYDPSLKPLSVSYDQATSLRILNNGHAFNVEFDDSQDKAVLKGGPLDGTYRLIQFHFHWGSLDGQGSEHTVDKKKYAAELHLVHWNTKYGDFGKAVQQPDGLAVLGIFLKVGSAKPGHQKVVDVLDSIKTKGKSADFTNFDPRGLLPESLDYWTYPGSLTTPPLLECVTWIVLKEPISVSSEQVLKFRKLNFNGEGEPEELMVDNWRPAQPLKNRQIKASFK

SEQ ID NO: 5760 - DNA, 777 bp, Artificial Sequence
  source: /note="Description of Artificial Sequence: Synthetic Destabilizing Domain (DD)"
tcccatcactgggggtacggcaaacacaacggacctgagcactggcataaggacttccccattgccaagggagagcgccagtcccctgttgacatcgacactcatacagccaagtatgacccttccctgaagcccctgtctgtttcctatgatcaagcaacttccctgagaatcctcaacaatggtcatgctttcaacgtggagtttgatgactctcaggacaaagcagtgctcaagggaggacccctggatggcacttacagattgattcagtttcactttcactggggttcacttgatggacaaggttcagagcatactgtggataaaaagaaatatgctgcagaacttcacttggttcactggaacaccaaatatggggattttgggaaagctgtgcagcaacctgatggactggccgttctaggtatttttttgaaggttggcagcgctaaaccgggccatcagaaagttgttgatgtgctggattccattaaaacaaagggcaagagtgctgacttcactaacttcgatcctcgtggcctccttcctgaatccctggattactggacctacccaggctcactgaccacccctcctcttctggaatgtgtgacctggattgtgctcaaggaacccatcagcgtcagcagcgagcaggtgttgaaattccgtaaacttaacttcaatggggagggtgaacccgaagaactgatggtggacaactggcgcccagctcagccactgaagaacaggcaaatcaaagcttccttcaaa

SEQ ID NO: 5761 - protein, 260 aa, Artificial Sequence
  source: /note="Description of Artificial Sequence: Synthetic Destabilizing Domain (DD)"
MSHHWGYGKHNGPEHWHKDFPIAKGERQSPVDIDTHTAKYDPSLKPLSVSYDQATSLRILNNGHAFNVEFDDSQDKAVLKGGPLDGTYRLIQFHFHWGSLDGQGSEHTVDKKKYAAELHLVHWNTKYGDFGKAVQQPDGLAVLGIFLKVGSAKPGHQKVVDVLDSIKTKGKSADFTNFDPRGLLPESLDYWTYPGSLTTPPLLECVTWIVLKEPISVSSEQVLKFRKLNFNGEGEPEELMVDNWRPAQPLKNRQIKASFK

SEQ ID NO: 5762 - DNA, 780 bp, Artificial Sequence
  source: /note="Description of Artificial Sequence: Synthetic Destabilizing Domain (DD)"
atgtcccatcactgggggtacggcaaacacaacggacctgagcactggcataaggacttccccattgccaagggagagcgccagtcccctgttgacatcgacactcatacagccaagtatgacccttccctgaagcccctgtctgtttcctatgatcaagcaacttccctgagaatcctcaacaatggtcatgctttcaacgtggagtttgatgactctcaggacaaagcagtgctcaagggaggacccctggatggcacttacagattgattcagtttcactttcactggggttcacttgatggacaaggttcagagcatactgtggataaaaagaaatatgctgcagaacttcacttggttcactggaacaccaaatatggggattttgggaaagctgtgcagcaacctgatggactggccgttctaggtatttttttgaaggttggcagcgctaaaccgggccatcagaaagttgttgatgtgctggattccattaaaacaaagggcaagagtgctgacttcactaacttcgatcctcgtggcctccttcctgaatccctggattactggacctacccaggctcactgaccacccctcctcttctggaatgtgtgacctggattgtgctcaaggaacccatcagcgtcagcagcgagcaggtgttgaaattccgtaaacttaacttcaatggggagggtgaacccgaagaactgatggtggacaactggcgcccagctcagccactgaagaacaggcaaatcaaagcttccttcaaa

SEQ ID NO: 5763 - protein, 306 aa, Homo sapiens
IWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCS

SEQ ID NO: 5764 - DNA, 918 bp, Artificial Sequence
  source: /note="Description of Artificial Sequence: Synthetic Construct"
atctgggagctgaagaaggacgtgtacgtggtggagctggactggtatcccgatgcccctggcgagatggtggtgctgacctgcgacacacctgaggaggatggcatcacctggacactggatcagtctagcgaggtgctgggcagcggcaagaccctgacaatccaggtgaaggagttcggcgacgccggccagtacacatgtcacaagggcggcgaggtgctgtctcacagcctgctgctgctgcacaagaaggaggacggcatttggtccacagacatcctgaaggatcagaaggagccaaagaacaagaccttcctgcggtgcgaggccaagaattatagcggccggttcacctgttggtggctgaccacaatcagcaccgatctgacattttccgtgaagtcctctaggggcagctccgacccccagggcgtgacatgcggagcagccaccctgtccgccgagagggtgcgcggcgataacaaggagtacgagtattccgtggagtgccaggaggactctgcctgtccagcagcagaggagagcctgcctatcgaagtgatggtggatgccgtgcacaagctgaagtacgagaattatacatctagcttctttatccgggacatcatcaagcccgatccacccaagaacctgcagctgaagcctctgaagaattctagacaggtggaggtgagctgggagtacccagacacctggtccacaccccactcttatttcagcctgaccttttgcgtgcaggtgcagggcaagagcaagagggagaagaaggaccgcgtgttcaccgataagacatccgccaccgtgatctgtaggaagaacgcctccatctctgtgagggcccaggatcgctactattcctctagctggtccgagtgggcctctgtgccctgtagc

SEQ ID NO: 5765 - DNA, 918 bp, Artificial Sequence
  source: /note="Description of Artificial Sequence: Synthetic Construct"
atctgggagctgaagaaggacgtgtacgtggtggagctggactggtatcccgatgcccctggcgagatggtggtgctgacctgcgacacaccagaggaggatggcatcacctggacactggatcagtctagcgaggtgctgggcagcggcaagaccctgacaatccaggtgaaggagttcggcgacgccggccagtacacatgtcacaagggcggcgaggtgctgtctcacagcctgctgctgctgcacaagaaggaggacggcatttggtccacagacatcctgaaggatcagaaggagccaaagaacaagaccttcctgcggtgcgaggccaagaattatagcggccggttcacctgttggtggctgaccacaatcagcaccgatctgacattttccgtgaagtcctctaggggcagctccgacccccagggcgtgacatgcggagcagccaccctgtccgccgagagggtgcgcggcgataacaaggagtacgagtattccgtggagtgccaggaggactctgcctgtccagcagcagaggagagcctgcctatcgaagtgatggtggatgccgtgcacaagctgaagtacgagaattatacatctagcttctttatccgggacatcatcaagcccgatccacccaagaacctgcagctgaagcctctgaagaattctagacaggtggaggtgagctgggagtacccagacacctggtccacaccccactcttatttcagcctgaccttttgcgtgcaggtgcagggcaagtccaagagggagaagaaggaccgcgtgttcaccgataagacatctgccaccgtgatctgtaggaagaacgcctccatctctgtgagggcccaggatcgctactattcctctagctggtccgagtgggcctctgtgccctgtagc

SEQ ID NO: 5766 - DNA, 918 bp, Artificial Sequence
  source: /note="Description of Artificial Sequence: Synthetic Construct"
atctgggagctgaagaaggacgtgtacgtggtggagctggactggtatcccgatgcccctggcgagatggtggtgctgacctgcgacacacctgaggaggatggcatcacctggacactggatcagtctagcgaggtgctgggctccggcaagaccctgacaatccaggtgaaggagttcggcgacgccggccagtacacatgtcacaagggcggcgaggtgctgtctcacagcctgctgctgctgcacaagaaggaggacggcatctggtccacagacatcctgaaggatcagaaggagccaaagaacaagaccttcctgaggtgcgaggccaagaattatagcggccgctttacctgttggtggctgaccacaatcagcaccgatctgacattttccgtgaagtcctctaggggcagctccgacccccagggcgtgacatgcggagcagccaccctgtccgccgagcgggtgagaggcgataacaaggagtacgagtattccgtggagtgccaggaggactctgcctgtccagcagcagaggagagcctgcctatcgaagtgatggtggatgccgtgcacaagctgaagtacgagaattatacatctagcttctttatcagggacatcatcaagcccgatccacccaagaacctgcagctgaagcctctgaagaattctcgccaggtggaggtgagctgggagtacccagacacctggagcacaccccactcttatttcagcctgaccttttgcgtgcaggtgcagggcaagtctaagcgggagaagaaggacagagtgttcaccgataagacaagcgccaccgtgatctgtcggaagaacgcctccatctctgtgcgggcccaggatagatactattcctctagctggtccgagtgggcctctgtgccctgtagc

SEQ ID NO: 5767 - DNA, 918 bp, Artificial Sequence
  source: /note="Description of Artificial Sequence: Synthetic Construct"
atctgggagctgaagaaggacgtgtacgtggtggagctggactggtatcccgatgcccctggcgagatggtggtgctgacctgcgacacacctgaggaggatggcatcacctggacactggatcagagctccgaggtgctgggaagcggcaagaccctgacaatccaggtgaaggagttcggcgacgccggccagtacacatgtcacaagggcggcgaggtgctgtctcacagcctgctgctgctgcacaagaaggaggacggcatttggtccacagacatcctgaaggatcagaaggagccaaagaacaagaccttcctgaggtgcgaggccaagaattatagcggccgctttacctgttggtggctgaccacaatcagcaccgatctgacattttccgtgaagtctagcagaggctcctctgacccccagggcgtgacatgcggagcagccaccctgtccgccgagcgggtgagaggcgataacaaggagtacgagtattccgtggagtgccaggaggactctgcctgtcctgcagcagaggagagcctgccaatcgaagtgatggtggatgccgtgcacaagctgaagtacgagaattatacaagctccttctttatcagggacatcatcaagcctgatccccctaagaacctgcagctgaagccactgaagaattctcgccaggtggaggtgagctgggagtacccagacacctggtccacaccccactcttatttcagcctgaccttttgcgtgcaggtgcagggcaagagcaagagggagaagaaggaccgcgtgttcaccgataagacatccgccaccgtgatctgtcggaagaacgcctccatctctgtgcgggcccaggatagatactattctagctcctggtccgagtgggcctctgtgccctgtagc

SEQ ID NO: 5768 - DNA, 918 bp, Artificial Sequence
  source: /note="Description of Artificial Sequence: Synthetic Construct"
atctgggagctgaagaaggacgtgtacgtggtggagctggactggtatcccgatgcccctggcgagatggtggtgctgacctgcgacacacctgaggaggatggcatcacctggacactggatcagagctccgaggtgctgggaagcggcaagaccctgacaatccaggtgaaggagttcggcgacgccggccagtacacatgtcacaagggcggcgaggtgctgtctcacagcctgctgctgctgcacaagaaggaggacggcatttggtccacagacatcctgaaggatcagaaggagccaaagaacaagaccttcctgcggtgcgaggccaagaattatagcggccggttcacctgttggtggctgaccacaatcagcaccgatctgacattttccgtgaagtctagccggggctcctctgacccacagggagtgacatgcggagcagccaccctgtccgccgagcgggtgagaggcgataacaaggagtacgagtattccgtggagtgccaggaggactctgcctgtcctgcagcagaggagagcctgccaatcgaagtgatggtggatgccgtgcacaagctgaagtacgagaattatacaagctccttctttatcagggacatcatcaagcctgatccccctaagaacctgcagctgaagccactgaagaattctcgccaggtggaggtgagctgggagtacccagacacctggtccacaccccactcttatttcagcctgaccttttgcgtgcaggtgcagggcaagtccaagcgggagaagaaggacagagtgttcaccgataagacatctgccaccgtgatctgtcggaagaacgcctccatctctgtgagggcccaggatcgctactattctagctcctggagcgagtgggcatccgtgccatgttct

SEQ ID NO: 5769 - DNA, 918 bp, Artificial Sequence
  source: /note="Description of Artificial Sequence: Synthetic Construct"
atctgggagctcaagaaagacgtgtacgtggtggaactggactggtaccccgacgcccctggcgaaatggtggtgctgacatgcgacacccctgaggaggatggcattacctggaccctcgatcagagctccgaggtgctgggcagcggcaaaaccctgaccatccaggtgaaggagtttggcgatgccggccagtacacatgtcacaagggcggcgaggtgctgagccactccctgctgctgctccacaagaaggaagatggcatctggagcaccgacattctgaaggatcagaaggagcccaagaacaagacattcctgaggtgtgaggccaagaactacagcggcaggtttacctgctggtggctgacaacaatcagcaccgacctcacattctccgtcaagtcctccaggggttcttccgaccctcaaggcgtgacatgcggcgctgccaccctgagcgctgagagagtcaggggcgacaacaaggagtacgagtacagcgtcgaatgtcaggaggacagcgcctgtcccgccgctgaagagagcctgcctatcgaggtgatggtggacgccgtgcacaaactgaagtatgagaattacacctccagcttcttcatcagggacatcatcaaacccgatccccccaagaacctgcagctgaagcctctgaagaacagcagacaggtcgaagtgtcctgggagtaccctgatacctggtccacaccccacagctacttcagcctgaccttttgcgtgcaggtgcagggcaagagcaaaagggagaagaaggacagggtgtttaccgacaagacctccgccacagtgatttgcagaaagaacgcctccatcagcgtgagggcccaggacaggtattacagcagctcctggagcgaatgggctagcgtgccctgtagc

SEQ ID NO: 5770 - DNA, 918 bp, Artificial Sequence
  source: /note="Description of Artificial Sequence: Synthetic Construct"
atctgggagctgaagaaggacgtgtacgtggtggagctggactggtatcccgatgcccctggcgagatggtggtgctgacctgcgacacacccgaggaggatggcatcacctggacactggatcagtctagcgaggtgctgggctccggcaagaccctgacaatccaggtgaaggagttcggcgacgccggccagtacacctgtcacaagggcggcgaggtgctgtcccactctctgctgctgctgcacaagaaggaggacggcatctggtctacagacatcctgaaggatcagaaggagcctaagaacaagaccttcctgcggtgcgaggccaagaattatagcggccggttcacctgttggtggctgaccacaatcagcaccgatctgacattttccgtgaagtcctctcggggcagctccgacccacagggagtgacatgcggagcagccaccctgtccgccgagagggtgcgcggcgataacaaggagtacgagtattccgtggagtgccaggaggactctgcctgtccagcagcagaggagagcctgccaatcgaagtgatggtggatgccgtgcacaagctgaagtacgagaattatacatctagcttctttatccgggacatcatcaagcccgatccccctaagaacctgcagctgaagcctctgaagaattctagacaggtggaggtgagctgggagtaccccgacacctggagcacacctcacagctatttctccctgaccttttgcgtgcaggtgcagggcaagtccaagagggagaagaaggaccgcgtgttcaccgataagacatctgccaccgtgatctgtcggaagaacgccagcatctccgtgagggcccaggatcgctactattcctctagctggtctgagtgggccagcgtgccctgttcc

SEQ ID NO: 5771 - DNA, 918 bp, Artificial Sequence
  source: /note="Description of Artificial Sequence: Synthetic Construct"
atctgggagctgaagaaggacgtgtacgtggtggagctggactggtatcctgatgccccaggcgagatggtggtgctgacatgcgacacccccgaggaggatggcatcacatggaccctggatcagtcctctgaggtgctgggctccggcaagacactgaccatccaggtgaaggagttcggcgacgccggccagtacacctgtcacaagggaggagaggtgctgagccactccctgctgctgctgcacaagaaggaggacggcatctggtccaccgacatcctgaaggatcagaaggagcccaagaacaagacattcctgagatgcgaggccaagaattatagcggcaggtttacctgttggtggctgacaaccatctccacagatctgaccttttctgtgaagagctcccggggctctagcgaccctcagggagtgacctgcggagcagccacactgtccgccgagcgggtgagaggcgataacaaggagtacgagtattccgtggagtgccaggaggactctgcctgtcctgcagcagaggagagcctgccaatcgaagtgatggtggatgccgtgcacaagctgaagtacgagaattatacctcctctttctttatcagagacatcatcaagccagatcctccaaagaacctgcagctgaagcccctgaagaatagcaggcaggtggaggtgtcctgggagtacccagacacatggagcaccccccacagctatttctccctgacattttgcgtgcaggtgcagggcaagtccaagcgcgagaagaaggaccgggtgttcacagataagacctctgccacagtgatctgtcgcaagaacgcctctatcagcgtgcgcgcccaggatcggtactatagctcctcttggtctgagtgggccagcgtgccttgttcc

SEQ ID NO: 5772 - DNA, 918 bp, Artificial Sequence
  source: /note="Description of Artificial Sequence: Synthetic Construct"
atctgggagctgaagaaggacgtgtacgtggtggagctggactggtatcccgatgcccctggcgagatggtggtgctgacctgcgacacacctgaggaggatggcatcacctggacactggatcagagctccgaggtgctgggcagcggcaagaccctgacaatccaggtgaaggagttcggcgacgccggccagtacacatgtcacaagggcggcgaggtgctgtctcacagcctgctgctgctgcacaagaaggaggacggcatctggtccacagacatcctgaaggatcagaaggagccaaagaacaagaccttcctgaggtgcgaggccaagaattattctggcaggttcacctgttggtggctgaccacaatcagcaccgatctgacattttccgtgaagtctagccggggctcctctgacccccagggagtgacatgcggagcagccaccctgtccgccgagagggtgagaggcgataacaaggagtacgagtattccgtggagtgccaggaggactctgcctgtcctgcagcagaggagagcctgccaatcgaagtgatggtggatgccgtgcacaagctgaagtacgagaattatacaagctccttctttatcagggacatcatcaagcctgatccccctaagaacctgcagctgaagccactgaagaattctagacaggtggaggtgagctgggagtacccagacacctggagcacaccccactcctatttctctctgaccttttgcgtgcaggtgcagggcaagagcaagagggagaagaaggacagagtgttcaccgataagacatccgccaccgtgatctgtcggaagaacgcctccatctctgtgcgggcccaggatcgctactattctagctcctggagcgagtgggcatccgtgccatgttct

SEQ ID NO: 5773 - DNA, 921 bp, Homo sapiens
atatgggaactgaagaaagatgtttatgtcgtagaattggattggtatccggatgcccctggagaaatggtggtcctcacctgtgacacccctgaagaagatggtatcacctggaccttggaccagagcagtgaggtcttaggctctggcaaaaccctgaccatccaagtcaaagagtttggagatgctggccagtacacctgtcacaaaggaggcgaggttctaagccattcgctcctgctgcttcacaaaaaggaagatggaatttggtccactgatattttaaaggaccagaaagaacccaaaaataagacctttctaagatgcgaggccaagaattattctggacgtttcacctgctggtggctgacgacaatcagtactgatttgacattcagtgtcaaaagcagcagaggctcttctgacccccaaggggtgacgtgcggagctgctacactctctgcagagagagtcagaggggacaacaaggagtatgagtactcagtggagtgccaggaggacagtgcctgcccagctgctgaggagagtctgcccattgaggtcatggtggatgccgttcacaagctcaagtatgaaaactacaccagcagcttcttcatcagggacatcatcaaacctgacccacccaagaacttgcagctgaagccattaaagaattctcggcaggtggaggtcagctgggagtaccctgacacctggagtactccacattcctacttctccctgacattctgcgttcaggtccagggcaagagcaagagagaaaagaaagatagagtcttcacggacaagacctcagccacggtcatctgccgcaaaaatgccagcattagcgtgcgggcccaggaccgctactatagctcatcttggagcgaatgggcatctgtgccctgcagttag

SEQ ID NO: 5774 - protein, 306 aa, Artificial Sequence
  source: /note="Description of Artificial Sequence: Synthetic Construct"
IWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPNNLQLKPLKNSRQVEVSWEYPDTWSTPHSYFSLTFCVQVQGKSKREKKDRVFTDKTSATVICRKNASISVRAQDRYYSSSWSEWASVPCS

SEQ ID NO: 5775 - DNA, 918 bp, Artificial Sequence
  source: /note="Description of Artificial Sequence: Synthetic Construct"
atatgggaactgaagaaagatgtttatgtcgtagaattggattggtatccggatgcccctggagaaatggtggtcctcacctgtgacacccctgaagaagatggtatcacctggaccttggaccagagcagtgaggtcttaggctctggcaaaaccctgaccatccaagtcaaagagtttggagatgctggccagtacacctgtcacaaaggaggcgaggttctaagccattcgctcctgctgcttcacaaaaaggaagatggaatttggtccactgatattttaaaggaccagaaagaacccaaaaataagacctttctaagatgcgaggccaagaattattctggacgtttcacctgctggtggctgacgacaatcagtactgatttgacattcagtgtcaaaagcagcagaggctcttctgacccccaaggggtgacgtgcggagctgctacactctctgcagagagagtcagaggggacaacaaggagtatgagtactcagtggagtgccaggaggacagtgcctgcccagctgctgaggagagtctgcccattgaggtcatggtggatgccgttcacaagctcaagtatgaaaactacaccagcagcttcttcatcagggacatcatcaaacctgacccacccaacaacttgcagctgaagccattaaagaattctcggcaggtggaggtcagctgggagtaccctgacacctggagtactccacattcctacttctccctgacattctgcgttcaggtccagggcaagagcaagagagaaaagaaagatagagtcttcaccgacaagacctcagccacggtcatctgccgcaaaaatgccagcattagcgtgcgggcccaggaccgctactatagctcatcttggagcgaatgggcatctgtgccctgcagt

SEQ ID NO: 5776 - DNA, 759 bp, Artificial Sequence
  source: /note="Description of Artificial Sequence: Synthetic Construct"
atgtggccccctgggtcagcctcccagccaccgccctcacctgccgcggccacaggtctgcatccagcggctcgccctgtgtccctgcagtgccggctcagcatgtgtccagcgcgcagcctcctccttgtggctaccctggtcctcctggaccacctcagtttggccagaaacctccccgtggccactccagacccaggaatgttcccatgccttcaccactcccaaaacctgctgagggccgtcagcaacatgctccagaaggccagacaaactctagaattttacccttgcacttctgaagagattgatcatgaagatatcacaaaagataaaaccagcacagtggaggcctgtttaccattggaattaaccaagaatgagagttgcctaaattccagagagacctctttcataactaatgggagttgcctggcctccagaaagacctcttttatgatggccctgtgccttagtagtatttatgaagacttgaagatgtaccaggtggagttcaagaccatgaatgcaaagcttctgatggaccctaagaggcagatctttctagatcaaaacatgctggcagttattgatgagctgatgcaggccctgaatttcaacagtgagactgtgccacaaaaatcctcccttgaagaaccggatttttataaaactaaaatcaagctctgcatacttcttcatgctttcagaattcgggcagtgactattgatagagtgatgagctatctgaatgcttcc

SEQ ID NO: 5777 - protein, 197 aa, Homo sapiens
RNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNAS

SEQ ID NO: 5778 - DNA, 591 bp, Artificial Sequence
  source: /note="Description of Artificial Sequence: Synthetic Construct"
agaaatctgccagtggcaacccctgacccaggaatgttcccttgcctgcaccacagccagaacctgctgcgggccgtgtccaatatgctgcagaaggccagacagacactggagttttacccttgtacctctgaggagatcgaccacgaggatatcacaaaggataagaccagcacagtggaggcctgcctgccactggagctgaccaagaacgagtcctgtctgaacagccgggaaaccagcttcatcaccaacggctcctgcctggcctctcgcaagaccagcttcatgatggccctgtgcctgtctagcatctacgaggacctgaagatgtatcaggtggagttcaagaccatgaacgccaagctgctgatggaccctaagaggcagatctttctggatcagaatatgctggccgtgatcgacgagctgatgcaggccctgaacttcaatagcgagacagtgccacagaagtcctctctggaggagcccgatttctacaagaccaagatcaagctgtgcatcctgctgcacgcctttaggatccgcgccgtgaccatcgacagagtgatgtcctatctgaacgcctct

SEQ ID NO: 5779 - DNA, 591 bp, Artificial Sequence
  source: /note="Description of Artificial Sequence: Synthetic Construct"
agaaatctgccagtggcaacccctgacccaggaatgttcccttgcctgcaccacagccagaacctgctgagggccgtgtccaatatgctgcagaaggcccgccagacactggagttttacccttgtaccagcgaggagatcgaccacgaggatatcacaaaggataagacctccacagtggaggcctgcctgccactggagctgaccaagaacgagagctgtctgaattcccgggagacatctttcatcaccaacggcagctgcctggcctccagaaagacatcttttatgatggccctgtgcctgtctagcatctacgaggacctgaagatgtatcaggtggagttcaagaccatgaacgccaagctgctgatggaccctaagaggcagatctttctggatcagaatatgctggccgtgatcgacgagctgatgcaggccctgaacttcaatagcgagacagtgccacagaagtcctctctggaggagcccgatttctacaagaccaagatcaagctgtgcatcctgctgcacgcctttaggatccgcgccgtgaccatcgaccgcgtgatgtcttatctgaacgcatcc

SEQ ID NO: 5780 - DNA, 591 bp, Artificial Sequence
  source: /note="Description of Artificial Sequence: Synthetic polynucleotide"
cgcaatctgccagtggcaacccctgacccaggaatgttcccttgcctgcaccacagccagaacctgctgcgggccgtgtccaatatgctgcagaaggcccgccagacactggagttttacccttgtacctctgaggagatcgaccacgaggatatcacaaaggataagaccagcacagtggaggcctgcctgccactggagctgaccaagaacgagagctgtctgaattccagggagacatctttcatcaccaacggcagctgcctggcctccagaaagacatcttttatgatggccctgtgcctgtctagcatctacgaggacctgaagatgtatcaggtggagttcaagaccatgaacgccaagctgctgatggaccctaagaggcagatctttctggatcagaatatgctggccgtgatcgacgagctgatgcaggccctgaacttcaattccgagacagtgccacagaagtcctctctggaggagcccgatttctacaagaccaagatcaagctgtgcatcctgctgcacgccttcaggatcagggccgtgaccatcgacagagtgatgagctatctgaacgccagc

SEQ ID NO: 5781 - DNA, 591 bp, Artificial Sequence
  source: /note="Description of Artificial Sequence: Synthetic polynucleotide"
agaaacctgcctgtcgctacccccgaccccggaatgttcccctgcctgcaccactcccagaacctcctgagggccgtgtccaacatgctgcagaaggctagacagaccctcgaattctacccctgtaccagcgaggagatcgaccatgaggacatcaccaaggataagaccagcaccgtggaggcttgcctgcctctggagctgaccaaaaacgagagctgcctgaacagcagggaaaccagcttcattaccaacggctcctgcctggcctccaggaagacatccttcatgatggccctgtgcctcagcagcatctacgaggacctgaagatgtatcaggtggagtttaagaccatgaatgccaagctgctgatggaccctaagaggcagatcttcctggaccagaatatgctggccgtgattgacgagctgatgcaggccctcaactttaacagcgagaccgtgccccagaaaagcagcctcgaagagcctgacttctacaaaaccaagattaagctgtgtatcctgctgcacgccttcaggatcagggccgtgaccatcgacagggtgatgagctacctgaacgccagt

SEQ ID NO: 5782 - DNA, 591 bp, Artificial Sequence
  source: /note="Description of Artificial Sequence: Synthetic polynucleotide"
cgcaatctgccagtggccacccctgacccaggcatgttcccctgcctgcaccacagccagaacctgctgagggccgtgtccaatatgctgcagaaggcccgccagacactggagttttacccttgtacctctgaggagatcgaccacgaggatatcacaaaggataagaccagcacagtggaggcctgcctgccactggagctgaccaagaacgagtcctgtctgaacagccgggaaaccagcttcatcaccaacggctcctgcctggcctctcgcaagaccagcttcatgatggccctgtgcctgtcctctatctacgaggacctgaagatgtatcaggtggagttcaagaccatgaacgccaagctgctgatggaccctaagcggcagatctttctggatcagaatatgctggccgtgatcgacgagctgatgcaggccctgaacttcaatagcgagacagtgccacagaagagctccctggaggagcccgatttctacaagaccaagatcaagctgtgcatcctgctgcacgcctttcggatcagagccgtgaccatcgacagagtgatgtcctatctgaatgcctct

SEQ ID NO: 5783 - DNA, 591 bp, Artificial Sequence
  source: /note="Description of Artificial Sequence: Synthetic polynucleotide"
agaaatctgccagtggccacccctgacccaggcatgttcccctgcctgcaccactctcagaacctgctgcgggccgtgagcaatatgctgcagaaggccagacagacactggagttttacccttgtacctccgaggagatcgaccacgaggatatcacaaaggataagacctctacagtggaggcctgcctgccactggagctgaccaagaacgagtcctgtctgaacagccgggaaaccagcttcatcaccaacggctcctgcctggcctctagaaagaccagcttcatgatggccctgtgcctgtcctctatctacgaggacctgaagatgtatcaggtggagttcaagaccatgaacgccaagctgctgatggaccctaagaggcagatctttctggatcagaatatgctggccgtgatcgacgagctgatgcaggccctgaacttcaatagcgagacagtgccacagaagagctccctggaggagcccgatttctacaagaccaagatcaagctgtgcatcctgctgcacgcctttaggatccgcgccgtgaccatcgaccgcgtgatgtcctatctgaatgcctct

SEQ ID NO: 5784 - DNA, 591 bp, Artificial Sequence
  source: /note="Description of Artificial Sequence: Synthetic polynucleotide"
agaaatctgccagtggccacccctgacccaggcatgttcccctgcctgcaccacagccagaacctgctgagggccgtgtccaatatgctgcagaaggcccgccagacactggagttttacccctgtaccagcgaggagatcgaccacgaggatatcacaaaggataagacctccacagtggaggcctgcctgcctctggagctgaccaagaacgagtcttgtctgaatagcagggagacatccttcatcaccaacggctcttgcctggccagccgcaagacatcctttatgatggccctgtgcctgtcctctatctacgaggacctgaagatgtatcaggtggagttcaagaccatgaacgccaagctgctgatggaccctaagaggcagatctttctggatcagaatatgctggccgtgatcgacgagctgatgcaggccctgaacttcaattccgagacagtgcctcagaagagctccctggaggagccagatttctacaagaccaagatcaagctgtgcatcctgctgcacgcctttcggatcagagccgtgaccatcgaccgcgtgatgtcttatctgaatgccagc

SEQ ID NO: 5785 - DNA, 591 bp, Artificial Sequence
  source: /note="Description of Artificial Sequence: Synthetic polynucleotide"
cggaatctgcctgtggcaacccccgaccctggaatgttcccatgcctgcaccacagccagaacctgctgcgcgccgtgtccaatatgctgcagaaggcccggcagaccctggagttttacccatgtacaagcgaggagatcgaccacgaggatatcaccaaggataagacatccaccgtggaggcatgcctgccactggagctgacaaagaacgagtcttgtctgaacagccgggagacaagcttcatcacaaacggctcttgcctggccagccggaagacctcctttatgatggccctgtgcctgagctccatctacgaggacctgaagatgtatcaggtggagttcaagacaatgaacgccaagctgctgatggaccccaagcgccagatctttctggatcagaatatgctggccgtgatcgacgagctgatgcaggccctgaactttaatagcgagacagtgccccagaagtctagcctggaggagcctgatttctacaagacaaagatcaagctgtgcatcctgctgcacgccttccggatcagagccgtgaccatcgacagagtgatgtcttatctgaatgccagc

SEQ ID NO: 5786 - DNA, 591 bp, Artificial Sequence
  source: /note="Description of Artificial Sequence: Synthetic polynucleotide"
agaaacctgcctgtcgctacccccgaccccggaatgttcccctgcctgcaccactcccagaacctcctgagggccgtgtccaacatgctgcagaaggctagacagaccctcgaattctacccctgtaccagcgaggagatcgaccatgaggacatcaccaaggataagaccagcaccgtggaggcttgcctgcctctggagctgaccaaaaacgagagctgcctgaacagcagggaaaccagcttcattaccaacggctcctgcctggcctccaggaagacatccttcatgatggccctgtgcctcagcagcatctacgaggacctgaagatgtatcaggtggagtttaagaccatgaatgccaagctgctgatggaccctaagaggcagatcttcctggaccagaatatgctggccgtgattgacgagctgatgcaggccctcaactttaacagcgagaccgtgccccagaaaagcagcctcgaagagcctgacttctacaaaaccaagattaagctgtgtatcctgctgcacgccttcaggatcagggccgtgaccatcgacagggtgatgagctacctgaacgccagc

SEQ ID NO: 5787 - DNA, 591 bp, Artificial Sequence
  source: /note="Description of Artificial Sequence: Synthetic Construct"
cgcaatctgccagtggccacccctgacccaggcatgttcccctgcctgcaccacagccagaacctgctgagggccgtgtccaatatgctgcagaaggcccgccagacactggagttttacccttgtaccagcgaggagatcgaccacgaggatatcacaaaggataagacctccacagtggaggcctgcctgccactggagctgaccaagaacgagtcctgtctgaacagccgggaaaccagcttcatcaccaacggctcctgcctggcctctcgcaagaccagcttcatgatggccctgtgcctgtcctctatctacgaggacctgaagatgtatcaggtggagttcaagaccatgaacgccaagctgctgatggaccctaagcggcagatctttctggatcagaatatgctggccgtgatcgacgagctgatgcaggccctgaacttcaatagcgagacagtgccacagaagagctccctggaggagcccgatttctacaagaccaagatcaagctgtgcatcctgctgcacgcctttcggatcagagccgtgaccatcgacagagtgatgtcctatctgaatgcctct

SEQ ID NO: 5788 - DNA, 591 bp, Artificial Sequence
  source: /note="Description of Artificial Sequence: Synthetic Construct"
agaaacctgcctgtcgctacccccgaccccggaatgttcccctgcctgcaccactcccagaacctcctgagggccgtgtccaacatgctgcagaaggctagacagaccctcgaattctacccctgtaccagcgaggagatcgaccatgaggacatcaccaaggataagaccagcaccgtggaggcttgcctgcctctggagctgaccaaaaacgagagctgcctgaacagcagggaaaccagcttcattaccaacggctcctgcctggcctccaggaagacatccttcatgatggccctgtgcctcagcagcatctacgaggacctgaagatgtatcaggtggagtttaagaccatgaatgccaagctgctgatggaccctaagaggcagatcttcctggaccagaatatgctggccgtgattgacgagctgatgcaggccctcaactttaacagcgagaccgtgccccagaaaagcagcctcgaagagcctgacttctacaaaaccaagattaagctgtgtatcctgctgcacgccttcaggatcagggccgtgaccatcgacagggtgatgagctacctgaacgcctcc

SEQ ID NO: 5789 - DNA, 582 bp, Artificial Sequence
  source: /note="Description of Artificial Sequence: Synthetic Construct"
gtggccactccagacccaggaatgttcccatgccttcaccactcccaaaacctgctgagggccgtcagcaacatgctccagaaggccagacaaactctagaattttacccttgcacttctgaagagattgatcatgaagatatcacaaaagataaaaccagcacagtggaggcctgtttaccattggaattaaccaagaatgagagttgcctaaattccagagagacctctttcataactaatgggagttgcctggcctccagaaagacctcttttatgatggccctgtgccttagtagtatttatgaagacttgaagatgtaccaggtggagttcaagaccatgaatgcaaagcttctgatggatcctaagaggcagatctttctagatcaaaacatgctggcagttattgatgagctgatgcaggccctgaatttcaacagtgagactgtgccacaaaaatcctcccttgaagaaccggatttttataaaactaaaatcaagctctgcatacttcttcatgctttcagaattcgggcagtgactattgatagagtgatgagctatctgaatgcttcctaa

SEQ ID NO: 5790 - DNA, 594 bp, Artificial Sequence
  source: /note="Description of Artificial Sequence: Synthetic Construct"
agaaacctccccgtggccactccagacccaggaatgttcccatgccttcaccactcccaaaacctgctgagggccgtcagcaacatgctccagaaggccagacaaactctagaattttacccttgcacttctgaagagattgatcatgaagatatcacaaaagataaaaccagcacagtggaggcctgtttaccattggaattaaccaagaatgagagttgcctaaattccagagagacctctttcataactaatgggagttgcctggcctccagaaagacctcttttatgatggccctgtgccttagtagtatttatgaagacttgaagatgtaccaggtggagttcaagaccatgaatgcaaagcttctgatggatcctaagaggcagatctttctagatcaaaacatgctggcagttattgatgagctgatgcaggccctgaatttcaacagtgagactgtgccacaaaaatcctcccttgaagaaccggatttttataaaactaaaatcaagctctgcatacttcttcatgctttcagaattcgggcagtgactattgatagagtgatgagctatctgaatgcttcctaa

SEQ ID NO: 5791 - DNA, 594 bp, Artificial Sequence
  source: /note="Description of Artificial Sequence: Synthetic Construct"
cgcaatctgccagtggccacccctgacccaggcatgttcccctgcctgcaccacagccagaacctgctgagggccgtgtccaatatgctgcagaaggcccgccagacactggagttttacccttgtacctctgaggagatcgaccacgaggatatcacaaaggataagaccagcacagtggaggcctgcctgccactggagctgaccaagaacgagtcctgtctgaacagccgggaaaccagcttcatcaccaacggctcctgcctggcctctcgcaagaccagcttcatgatggccctgtgcctgtcctctatctacgaggacctgaagatgtatcaggtggagttcaagaccatgaacgccaagctgctgatggaccctaagcggcagatctttctggatcagaatatgctggccgtgatcgacgagctgatgcaggccctgaacttcaatagcgagacagtgccacagaagagctccctggaggagcccgatttctacaagaccaagatcaagctgtgcatcctgctgcacgcctttcggatcagagccgtgaccatcgacagagtgatgtcctatctgaatgcctcttga

SEQ ID NO: 5792 - DNA, 594 bp, Artificial Sequence
  source: /note="Description of Artificial Sequence: Synthetic Construct"
cgcaatctgccagtggccacccctgacccaggcatgttcccctgcctgcaccacagccagaacctgctgagggccgtgtccaatatgctgcagaaggcccgccagacactggagttttacccttgtaccagcgaggagatcgaccacgaggatatcacaaaggataagacctccacagtggaggcctgcctgccactggagctgaccaagaacgagtcctgtctgaacagccgggaaaccagcttcatcaccaacggctcctgcctggcctctcgcaagaccagcttcatgatggccctgtgcctgtcctctatctacgaggacctgaagatgtatcaggtggagttcaagaccatgaacgccaagctgctgatggaccctaagcggcagatctttctggatcagaatatgctggccgtgatcgacgagctgatgcaggccctgaacttcaatagcgagacagtgccacagaagagctccctggaggagcccgatttctacaagaccaagatcaagctgtgcatcctgctgcacgcctttcggatcagagccgtgaccatcgacagagtgatgtcctatctgaatgcctcttga

SEQ ID NO: 5793 - DNA, 594 bp, Artificial Sequence
  source: /note="Description of Artificial Sequence: Synthetic Construct"
agaaatctgccagtggccacccctgacccaggcatgttcccctgcctgcaccactctcagaacctgctgcgggccgtgagcaatatgctgcagaaggccagacagacactggagttttacccttgtacctccgaggagatcgaccacgaggatatcacaaaggataagacctctacagtggaggcctgcctgccactggagctgaccaagaacgagtcctgtctgaacagccgggaaaccagcttcatcaccaacggctcctgcctggcctctagaaagaccagcttcatgatggccctgtgcctgtcctctatctacgaggacctgaagatgtatcaggtggagttcaagaccatgaacgccaagctgctgatggaccctaagaggcagatctttctggatcagaatatgctggccgtgatcgacgagctgatgcaggccctgaacttcaatagcgagacagtgccacagaagagctccctggaggagcccgatttctacaagaccaagatcaagctgtgcatcctgctgcacgcctttaggatccgcgccgtgaccatcgaccgcgtgatgtcctatctgaatgcctcttga

SEQ ID NO: 5794 - DNA, 594 bp, Artificial Sequence
  source: /note="Description of Artificial Sequence: Synthetic Construct"
agaaacctgcctgtcgctacccccgaccccggaatgttcccctgcctgcaccactcccagaacctcctgagggccgtgtccaacatgctgcagaaggctagacagaccctcgaattctacccctgtaccagcgaggagatcgaccatgaggacatcaccaaggataagaccagcaccgtggaggcttgcctgcctctggagctgaccaaaaacgagagctgcctgaacagcagggaaaccagcttcattaccaacggctcctgcctggcctccaggaagacatccttcatgatggccctgtgcctcagcagcatctacgaggacctgaagatgtatcaggtggagtttaagaccatgaatgccaagctgctgatggaccctaagaggcagatcttcctggaccagaatatgctggccgtgattgacgagctgatgcaggccctcaactttaacagcgagaccgtgccccagaaaagcagcctcgaagagcctgacttctacaaaaccaagattaagctgtgtatcctgctgcacgccttcaggatcagggccgtgaccatcgacagggtgatgagctacctgaacgccagctaa

SEQ ID NO: 5795 - DNA, 597 bp, Artificial Sequence
  source: /note="Description of Artificial Sequence: Synthetic Construct"
agaaatctgccagtggccacccctgacccaggcatgttcccctgcctgcaccacagccagaacctgctgagggccgtgtccaatatgctgcagaaggcccgccagacactggagttttacccctgtaccagcgaggagatcgaccacgaggatatcacaaaggataagacctccacagtggaggcctgcctgcctctggagctgaccaagaacgagtcttgtctgaatagcagggagacatccttcatcaccaacggctcttgcctggccagccgcaagacatcctttatgatggccctgtgcctgtcctctatctacgaggacctgaagatgtatcaggtggagttcaagaccatgaacgccaagctgctgatggaccctaagaggcagatctttctggatcagaatatgctggccgtgatcgacgagctgatgcaggccctgaacttcaattccgagacagtgcctcagaagagctccctggaggagccagatttctacaagaccaagatcaagctgtgcatcctgctgcacgcctttcggatcagagccgtgaccatcgaccgcgtgatgtcttatctgaatgccagcggatcc

SEQ ID NO: 5796 - DNA, 597 bp, Artificial Sequence
  source: /note="Description of Artificial Sequence: Synthetic Construct"
cggaatctgcctgtggcaacccccgaccctggaatgttcccatgcctgcaccacagccagaacctgctgcgcgccgtgtccaatatgctgcagaaggcccggcagaccctggagttttacccatgtacaagcgaggagatcgaccacgaggatatcaccaaggataagacatccaccgtggaggcatgcctgccactggagctgacaaagaacgagtcttgtctgaacagccgggagacaagcttcatcacaaacggctcttgcctggccagccggaagacctcctttatgatggccctgtgcctgagctccatctacgaggacctgaagatgtatcaggtggagttcaagacaatgaacgccaagctgctgatggaccccaagcgccagatctttctggatcagaatatgctggccgtgatcgacgagctgatgcaggccctgaactttaatagcgagacagtgccccagaagtctagcctggaggagcctgatttctacaagacaaagatcaagctgtgcatcctgctgcacgccttccggatcagagccgtgaccatcgacagagtgatgtcttatctgaatgccagcggatcc

SEQ ID NO: 5797 - DNA, 593 bp, Artificial Sequence
  source: /note="Description of Artificial Sequence: Synthetic polynucleotide"
cgcaatctgccagtggccacccctgacccaggcatgttcccctgcctgcaccacagccagaacctgctgagggccgtgtccaatatgctgcagaaggcccgccagacactggagttttacccttgtaccagcgaggagatcgaccacgaggatatcacaaaggataagacctccacagtggaggcctgcctgccactggagctgaccaagaacgagtcctgtctgaacagccgggaaaccagcttcatcaccaacggctcctgcctggcctctcgcaagaccagcttcatgatggccctgtgcctgtcctctatctacgaggacctgaagatgtatcaggtggagttcaagaccatgaacgccaagctgctgatggaccctaagcggcagatctttctggatcagaatatgctggccgtgatcgacgagctgatgcaggccctgaacttcaatagcgagacagtgccacagaagagctccctggaggagcccgatttctacaagaccaagatcaagctgtgcatcctgctgcacgcctttcggatcagagccgtgaccatcgacagagtgatgtcctatctgaatgcctcttg

SEQ ID NO: 5798 - protein, 193 aa, Homo sapiens
VATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNAS

SEQ ID NO: 5799-5805 - skipped (7 entries)

SEQ ID NO: 5806 - protein, 12 aa, Artificial Sequence
  source: /note="Description of Artificial Sequence: Synthetic Linker"
GGSGGGSGGGSG

SEQ ID NO: 5807 - DNA, 36 bp, Artificial Sequence
  source: /note="Description of Artificial Sequence: Synthetic Linker"
ggaggatccggaggtggaagtggaggtggatctggt

SEQ ID NO: 5808 - protein, 533 aa, Artificial Sequence
  source: /note="Description of Artificial Sequence: Synthetic construct"
MSHHWGYGKHNGPEHWHKDFPIAKGERQSPVDIDTHTAKYDPSLKPLSVSYDQATSLRILNNGHAFNVEFDDSQDKAVLKGGPLDGTYRLIQFHFHWGSLDGQGSEHTVDKKKYAAELHLVHWNTKYGDFGKAVQQPDGLAVLGIFLKVGSAKPGHQKVVDVLDSIKTKGKSADFTNFDPRGLLPESLDYWTYPGSLTTPPLLECVTWIVLKEPISVSSEQVLKFRKLNFNGEGEPEELMVDNWRPAQPLKNRQIKASFKGGSGGGSGGGSGMIETYNQTSPRSAATGLPISMKIFMYLLTVFLITQMIGSALFAVYLHRRLDKIEDERNLHEDFVFMKTIQRCNTGERSLSLLNCEEIKSQFEGFVKDIMLNKEETKKENSFEMQKGDQNPQIAAHVISEASSKTTSVLQWAEKGYYTMSNNLVTLENGKQLTVKRQGLYYIYAQVTFCSNREASSQAPFIASLCLKSPGRFERILLRAANTHSSAKPCGQQSIHLGGVFELQPGASVFVNVTDPSQVSHGTGFTSFGLLKL

SEQ ID NO: 5809 - DNA, 1602 bp, Artificial Sequence
  source: /note="Description of Artificial Sequence: Synthetic construct"
atgtcccatcactgggggtacggcaaacacaacggacctgagcactggcataaggacttccccattgccaagggagagcgccagtcccctgttgacatcgacactcatacagccaagtatgacccttccctgaagcccctgtctgtttcctatgatcaagcaacttccctgagaatcctcaacaatggtcatgctttcaacgtggagtttgatgactctcaggacaaagcagtgctcaagggaggacccctggatggcacttacagattgattcagtttcactttcactggggttcacttgatggacaaggttcagagcatactgtggataaaaagaaatatgctgcagaacttcacttggttcactggaacaccaaatatggggattttgggaaagctgtgcagcaacctgatggactggccgttctaggtatttttttgaaggttggcagcgctaaaccgggccatcagaaagttgttgatgtgctggattccattaaaacaaagggcaagagtgctgacttcactaacttcgatcctcgtggcctccttcctgaatccctggattactggacctacccaggctcactgaccacccctcctcttctggaatgtgtgacctggattgtgctcaaggaacccatcagcgtcagcagcgagcaggtgttgaaattccgtaaacttaacttcaatggggagggtgaacccgaagaactgatggtggacaactggcgcccagctcagccactgaagaacaggcaaatcaaagcttccttcaaaggaggatccggaggtggaagtggaggtggatctggtatgatcgaaacatacaaccaaacttctccccgatctgcggccactggactgcccatcagcatgaaaatttttatgtatttacttactgtttttcttatcacccagatgattgggtcagcactttttgctgtgtatcttcatagaaggttggacaagatagaagatgaaaggaatcttcatgaagattttgtattcatgaaaacgatacagagatgcaacacaggagaaagatccttatccttactgaactgtgaggagattaaaagccagtttgaaggctttgtgaaggatataatgttaaacaaagaggagacgaagaaagaaaacagctttgaaatgcaaaaaggtgatcagaatcctcaaattgcggcacatgtcataagtgaggccagcagtaaaacaacatctgtgttacagtgggctgaaaaaggatactacaccatgagcaacaacttggtaaccctggaaaatgggaaacagctgaccgttaaaagacaaggactctattatatctatgcccaagtcaccttctgttccaatcgggaagcttcgagtcaagctccatttatagccagcctctgcctaaagtcccccggtagattcgagagaatcttactcagagctgcaaatacccacagttccgccaaaccttgcgggcaacaatccattcacttgggaggagtatttgaattgcaaccaggtgcttcggtgtttgtcaatgtgactgatccaagccaagtgagccatggcactggcttcacgtcctttggcttactcaaactctga

SEQ ID NO: 5810 - protein, 260 aa, Homo sapiens
MSHHWGYGKHNGPEHWHKDFPIAKGERQSPVDIDTHTAKYDPSLKPLSVSYDQATSLRILNNGHAFNVEFDDSQDKAVLKGGPLDGTYRLIQFHFHWGSLDGQGSEHTVDKKKYAAELHLVHWNTKYGDFGKAVQQPDGLAVLGIFLKVGSAKPGLQKVVDVLDSIKTKGKSADFTNFDPRGLLPESLDYWTYPGSLTTPPLLECVTWIVLKEPISVSSEQVLKFRKLNFNGEGEPEELMVDNWRPAQPLKNRQIKASFK

SEQ ID NO: 5811 - protein, 22 aa, Artificial Sequence
  source: /note="Description of Artificial Sequence: Synthetic Destabilizing Domain (DD)"
LMVDNWRPAQPLKNRQIKASFK

SEQ ID NO: 5812 - DNA, 708 bp, Artificial Sequence
  source: /note="Description of Artificial Sequence: Synthetic Destabilizing Domain (DD)"
tcccatcactgggggtacggcaaacacaacggacctgagcactggcataaggacttccccattgccaagggagagcgccagtcccctgttgacatcgacactcatacagccaagtatgacccttccctgaagcccctgtctgtttcctatgatcaagcaacttccctgaggatcctcaacaatggtcatgctttcaacgtggagtttgatgactctcaggacaaagcagtgctcaagggaggacccctggatggcacttacagattgattcagtttcactttcactggggttcacttgatggacaaggttcagagcatactgtggataaaaagaaatatgctgcagaacttcacttggttcactggaacaccaaatatggggattttgggaaagctgtgcagcaacctgatggactggccgttctaggtatttttttgaaggttggcagcgctaaaccgggccttcagaaagttgttgatgtgctggattccattaaaacaaagggcaagagtgctgacttcactaacttcgatcctcgtggcctccttcctgaatccctggattactggacctacccaggctcactgaccacccctcctcttctggaatgtgtgacctggattgtgctcaaggaacccatcagcgtcagcagcgagcaggtgttgaaattccgtaaacttaacttcaatggggagggtgaacccgaa

SEQ ID NO: 5813 - DNA, 777 bp, Artificial Sequence
  source: /note="Description of Artificial Sequence: Synthetic Destabilizing Domain (DD)"
tcccatcactgggggtacggcaaacacaacggacctgagcactggcataaggacttccccattgccaagggagagcgccagtcccctgttgacatcgacactcatacagccaagtatgacccttccctgaagcccctgtctgtttcctacgatcaagcaacttccctgaggaacctcaacaatggtcatgctttcaacgtggagtttgatgactctcaggacaaagcagtgctcaagggaggacccctggatggcacttacagattgattcagtttcactttcactggggttcacttgatagacaaggttcagagcatactgtggataaaaagaaatatgctgcagaacttcacttggttcactggaacaccaaatatggggattttgggaaagctgtgcagcaacctgatggactggccgttctaggtatttttttgaaggttggcagcgctaaaccgggccttcagaaagttgttgatgtgctggattccattaaaacaaagggcaagagtgctgacttcactaacttcgatcctcgtggcctccttcctgaatccctggattactggacctacccaggctcactgaccacccctcctcttctggaatgtgtgacctggattgtgctcaaggaacccatcagcgtcagcagcgagcaggtgttgaaattccgtaaacttaacttcaatggggagggtgaacccgaagaactgatggtggacaactggcgcccagctcagccactgaagaacaggcaaatcaaagcttccttcaaa

SEQ ID NO: 5814 - DNA, 777 bp, Artificial Sequence
  source: /note="Description of Artificial Sequence: Synthetic Destabilizing Domain (DD)"
tcccatcactgggggtacggcaaacacaacggacctgagcactggcataaggacttccccattgccaagggagagcgccagtcccctgttgacatcgacactcatacagccaagtatgacccatccctgaagcccctgtctgtttcctacgatcaagcaacttccctgaggaacctcaacaatggtcatgctttcaacgtggagtttgatgactctcaggacaaagcagtgctcaagggaggacccctggatggcacttacagattgattcagtttcactttcactggggttcacttgatagacaaggttcagagcatactgtggataaaaagaaatatgctgcagaacttcacttggttcactggaacaccaaatatggggattttgggaaagctgtgcagcaacctgatggactggccgttctaggtatttttttgaaggttggcagcgctaaaccgggccttcagaaagttgttgatgtgctggattccattaaaacaaagggcaagagtgctgacttcactaacttcgatcctcgtggcctccttcctgaatccctggattactggacctacccaggctcactgaccacccctcctcttctggaatgtgtgacctggattgtgctcaaggaacccatcagcgtcagcagcgagcaggtgttgaaattccgtaaacttaacttcaatggagagggtgaacccgaagaactgatggtggacaactggcgcccagctcagccactgaagaacaggcaaatcaaagcttccttcaaa

SEQ ID NO: 5815 - DNA, 777 bp, Artificial Sequence
  source: /note="Description of Artificial Sequence: Synthetic Destabilizing Domain (DD)"
tcccatcactgggggtacggcaaacacaacggacctgagcactggcataaggacttccccattgccaagggagagcgccagtcccctgttgacatcgacactcatacagccaagtatgacccatccctgaagcccctgtctgtttcctacgatcaagcaacttccctgaggaacctcaacaatggtcatgctttcaacgtggagtttgatgactctcaggacaaagcagtgctcaagggaggacccctggatggcacttacagattgattcagtttcactttcactggggttcacttgatagacaaggttcagagcatactgtggataaaaagaaatatgctgcagaacttcacttggttcactggaacaccaaatatggggattttgggaaagctgtgcagcaacctgatggactggccgttctaggtatttttttgaaggttggcagcgctaaaccgggccttcagaaagttgttgatgtgctggattccattaaaacaaagggcaagagtgctgacttcactaacttcgatcctcgtggcctccttcctgaatccctggattactggacctacccaggctcactgaccacccctcctcttctggaatgtgtgacctggattgtgctcaaggaacccatcagcgtcagcagcgagcaggtgttgaaattccgtaaacttaacttcaatggggagggtgaacccgaagaactgatggtggacaactggcgcccagctcagccactgaagaacaggcaaatcaaagcttccttcaaa

SEQ ID NO: 5816 - DNA, 777 bp, Artificial Sequence
  source: /note="Description of Artificial Sequence: Synthetic Destabilizing Domain (DD)"
tcccatcactgggggtacggcaaacacaacggacctgagcactggcataaggacttccccattgccaagggagagcgccagtcccctgttgacatcgacactcatacagccaagtatgacccttccctgaagcccctgtctgtttcctatgatcaagcaacttccctgaggatcctcaacaatggtcatgctttcaacgtggagtttgatgactctcaggacaaagcagtgctcaagggaggacccctggatggcacttacagattgattcagtttcactttcactggggttcacttgatggacaaggttcagagcatactgtggataaaaagaaatatgctgcagaacttcacttggttcactggaacaccaaatatggggattttgggaaagctgtgcagcaacctgatggactggccgttctaggtatttttttgaaggttggcagcgctaaaccgggccatcagaaagttgttgatgtgctggattccattaaaacaaagggcaagagtgctgacttcactaacttcgatcctcgtggcctccttcctgaatccctggattactggacctacccaggctcactgaccacccctcctcttctggaatgtgtgacctggattgtgctcaaggaacccatcagcgtcagcagcgagcaggtgttgaaattccgtaaacttaacttcaatggggagggtgaacccgaagaactgatggtggacaactggcgcccagctcagccactgaagaacaggcaaatcaaagcttccttcaaa

SEQ ID NO: 5817 - protein, 259 aa, Artificial Sequence
  source: /note="Description of Artificial Sequence: Synthetic Destabilizing Domain (DD)"
SHHWGYGKHNGPEHWHKDFPIAKGERQSPVDIDTQTAKYDPTLKPLSVSFDQATSLRILNNGHAFDVEFDDSQDKAVLKGGPLDGTYRLIQFHFHWGSLDGQGSEHTVDKKKYAAELHLVHWNTKYGDFWKAVQQPDGLAVLGIFLKVGSAKPGLQKVVDVLDSIKTKGKSADFTNFDPRGLLPESLDYWTYPGSLTTPPLLECVTWIVLKEPISVSSEQVLKFHKLNFNGEGEPEELMVDNWRPAQPLKNRQIKASFK

SEQ ID NO: 5818 - DNA, 777 bp, Artificial Sequence
  source: /note="Description of Artificial Sequence: Synthetic Destabilizing Domain (DD)"
tcccatcactgggggtacggcaaacacaacggacctgaacactggcataaggacttccccattgccaagggagagcgccagtcccctgttgacatcgacactcaaacagccaagtatgaccctaccctgaagcccctgtctgtttcctttgatcaagcaacttccctgaggatcctcaataatggtcatgctttcgacgtggagtttgatgactctcaggacaaagcagtgctcaagggaggacccctggatggcacttacagattgattcagtttcactttcactggggttcacttgatggacaaggttcagagcatactgtggataaaaagaaatatgctgcagaacttcacttggttcactggaacaccaaatatggggatttttggaaagctgtgcagcaacctgatggactggccgttctaggtatttttttgaaggttggcagcgctaaaccgggccttcagaaagttgttgatgtgctggattccattaaaacaaagggcaagagtgctgacttcactaacttcgatcctcgtggcctccttcctgaatccctggattactggacctacccaggctcactgaccacccctcctcttctggaatgtgtgacctggattgtgctcaaggaacccatcagcgtcagcagcgagcaggtgttgaaattccataaacttaacttcaatggggagggtgaacccgaagaactgatggtggacaactggcgcccagctcagccactgaagaacaggcaaatcaaagcttccttcaaa

SEQ ID NO: 5819 - protein, 259 aa, Artificial Sequence
  source: /note="Description of Artificial Sequence: Synthetic Destabilizing Domain (DD)"
SHHWGYGKHNGPEHWHKDFPIAKGERQSPVDIDTHTAKYDPSLKPLSVSYDQATSLRILNNGHAFNVEIDDSQDKAVLKGGPLDGTYRLIQFHFHWGSLDGQGSEHTVDKKKYAAELHLVHWNTKYGDFGKAVQQPDGLAVLGIVLKVGSAKPGLQKVVDVLDSIKTKGKSADFTNFDPRGLLPESLDYWTYPGSLTTPPLLECVTWIVLKEPISVSSEQVLKFRKLNFNGEGEPEELMVDNWRPAQPLKNRQIKASFK

SEQ ID NO: 5820 - DNA, 777 bp, Artificial Sequence
  source: /note="Description of Artificial Sequence: Synthetic Destabilizing Domain (DD)"
tcccatcactgggggtacggcaaacacaacggacctgagcactggcataaggacttccccattgccaagggagagcgccagtcccctgttgacatcgacactcatacagctaagtatgacccttccctgaagcccctgtctgtttcctatgatcaagcaacttccctgaggatcctcaacaatggtcatgctttcaacgtggagattgatgactctcaggacaaagcggtgctcaagggaggacccctggatggcacttacagattgattcagtttcactttcactggggttcacttgatggacaaggttcagagcatactgtggataaaaagaaatatgctgcagaacttcacttggttcactggaacaccaaatatggggattttgggaaagctgtgcagcaacctgatggactggccgttctaggtattgttttgaaggttggcagcgctaaaccgggccttcagaaagttgttgatgtgctggattccattaaaacaaagggcaagagtgctgacttcactaacttcgatcctcgtggcctccttcctgaatccctggattactggacctacccaggctcactgaccacccctcctcttctggaatgtgtgacctggattgtgctcaaggaacccatcagcgtcagcagcgagcaggtgttgaaattccgtaaacttaacttcaatggggagggtgaacccgaagaactgatggtggacaactggcgcccagctcagccactgaagaacaggcaaatcaaagcttccttcaaa

SEQ ID NO: 5821 - protein, 259 aa, Artificial Sequence
  source: /note="Description of Artificial Sequence: Synthetic Destabilizing Domain (DD)"
SHHWGYGKHNGPEHWHKDFPIAKGELQSPVDIDTHTAKYDPSLKPLSVSYDQATSLRILNNGHAFNVEFDDSQDKAVLKGGPLDGIYRLIQFHFHWGSLDGQGSEHTVDKKKYAAELHLVYWNTKYGDFGKAVQQPDGLAVLGIFLKVGSAKPGLQKVVDVLDSIKTKGKSADFTNFDPRGLLPESLDYWTYPGSLTTPPLLECVTWIVLKEPISVSSEQVLKFRKLNFNGEGEPEELMVDNWRPAQPLKDRQIKASFK

SEQ ID NO: 5822 - DNA, 777 bp, Artificial Sequence
  source: /note="Description of Artificial Sequence: Synthetic Destabilizing Domain (DD)"
tcccatcactgggggtacggcaaacacaacggacctgagcactggcataaggacttccccattgccaagggagagctccagtcccctgttgacatcgacactcatacagccaagtatgacccttccctgaagcccctgtctgtttcctatgatcaagcaacttccctgaggatcctcaacaatggtcatgctttcaacgtggagtttgatgactctcaggacaaagcagtgctcaagggaggacccctggatggcatttacagattgattcagtttcactttcactggggttcacttgatggacaaggttcagagcatactgtggataaaaagaaatatgctgcagaacttcacttggtttactggaacaccaaatatggggattttgggaaagctgtgcagcaacctgatggactggccgttctaggtatttttttgaaggttggcagcgctaaaccgggccttcagaaagttgttgatgtgctggattccattaaaacaaagggcaagagtgctgacttcactaacttcgatcctcgtggcctccttcctgaatccctggattactggacctacccaggctcactgaccacccctcctcttctggaatgtgtgacctggattgtgctcaaggaacccatcagcgtcagcagcgagcaggtgttgaaattccgtaaacttaacttcaatggggagggtgaacccgaagaactgatggtggacaactggcgcccagctcagccactgaaggacaggcaaatcaaagcttccttcaaa

SEQ ID NO: 5823 - protein, 259 aa, Artificial Sequence
  source: /note="Description of Artificial Sequence: Synthetic Destabilizing Domain (DD)"
SHHWGYGKHNGPEHWHKDFPIAKGERQSPVDIDTHTAKYDPSLNPLSVSYDQATSLRILNNGHAFNLEFDDSQDKAVLKGGPLDGTYRLIQFHFHWGSLDGQGSEHTVDKKKYAAELYLVHWNTKYGDFGKAVQQPDGLAVLGIFLKVGSAKPGLQKVVDVLDSIKTRGKSADFTNFEPRGLLPESLDYWTYPGSLTTPPLLECVTWIVLKEPISVSSEQVLKFRKLNFNGEGEPEELMVDNWRPAQPLKNRQIKASFK

SEQ ID NO: 5824 - DNA, 777 bp, Artificial Sequence
  source: /note="Description of Artificial Sequence: Synthetic Destabilizing Domain (DD)"
tcccatcactgggggtacggcaaacacaacggacctgagcactggcataaggacttccccattgccaaaggagagcgccagtcccctgttgacatcgacactcatacagccaagtatgacccttccctgaatcccctgtctgtttcctatgatcaagcaacttccctgaggatcctcaacaatggtcatgctttcaacttggagtttgatgactctcaggacaaagcagtgctcaagggaggacccctggatggcacttacagattgattcagtttcactttcactggggttcacttgatggacaaggttcagagcatactgtggataaaaagaaatatgctgcagaactttacttggttcactggaacaccaaatatggggattttgggaaagctgtgcagcaacctgatggactggccgttctaggtatttttttgaaggttggcagcgctaaaccgggccttcagaaagttgttgatgtgctggattccattaaaacaaggggcaagagtgctgacttcactaacttcgaacctcgtggcctccttcctgaatccctggattactggacctacccaggctcactgaccacccctcctcttctggaatgtgtgacctggattgtgctcaaggaacccatcagcgtcagcagcgagcaggtgttgaaattccgaaaacttaacttcaatggggagggtgaacccgaagaactgatggtggacaactggcgcccagctcagccactgaagaacaggcaaatcaaagcttccttcaaa

SEQ ID NO: 5825 - protein, 259 aa, Artificial Sequence
  source: /note="Description of Artificial Sequence: Synthetic Destabilizing Domain (DD)"
SHHWGYGKHNGPELWHKDFPIAKGERQSPVDIDTHTAKYDPSLKPLSVSYDQVTSLRILNNGHAFNVEFDDSQDKAVLKGGPLDGTYRLIQFHFHWGSLDGQGSEHTVDEKKYAAELHLVHWNTKYGDFGKAVQQPDGLAVLGIFLKVGSAKPGLQKVVDVLDSIKTKGKSADFTNFDPRGLLPESLDYWTYPGSLTTPPLLECVTWIVLKEPISVSSKQVLKIRKLNFNGEGEPEELMVDNWRPAQPLKNRQIKASFK

SEQ ID NO: 5826 - DNA, 777 bp, Artificial Sequence
  source: /note="Description of Artificial Sequence: Synthetic Destabilizing Domain (DD)"
tcccatcactgggggtacggcaaacacaacggacctgagctctggcataaggacttccccattgccaagggagagcgccagtcccctgttgacatcgacactcatacagccaagtatgacccttccctgaagcccctgtctgtttcctatgatcaagtaacttccctgaggatcctcaacaatggtcatgctttcaacgtggagtttgatgactctcaggacaaagcagtgctcaagggaggacccctggatggcacttacagattgattcagtttcactttcactggggttcacttgatggacaaggttcagagcatactgtggatgaaaagaaatatgctgcagaacttcacttggttcactggaacaccaaatatggggattttgggaaagctgtgcagcaacctgatggactggccgttctaggtatttttttgaaggttggcagcgctaaaccgggccttcagaaagttgttgatgtgctggattccattaaaacaaagggcaagagtgctgacttcactaacttcgatcctcgtggcctccttcctgaatccctggattactggacctacccaggctcactgaccacccctcctcttctggaatgtgtgacctggattgtgctcaaggaacccatcagcgtcagcagcaagcaggtgttgaaaatccgtaaacttaacttcaatggggagggtgaacccgaagaactgatggtggacaactggcgcccagctcagccactgaagaacaggcaaatcaaagcttccttcaaa

SEQ ID NO: 5827 - protein, 259 aa, Artificial Sequence
  source: /note="Description of Artificial Sequence: Synthetic Destabilizing Domain (DD)"
SHHWGYGKHNGSEHWHKDFPIAKGERQSPVDIDTHTAKYDPSLKPLSVSYDQATSLRILNNGHAFNVEFDDSQDKAVLKGGALDGTYRLIQFHFHWGSLGGQGSEHTVDNKKYAAELHLVHWNTKYGDFGKAVQQPDGLAVLGIFLKVGSAKPGLQKVVDVLDSIKTKGKSADFTNFDPRGLLPESLDYWTYPGSLTTPPLLECVTWIVLKEPISVSSEQVLKFRKLNINGEGEPEELMVDNWRPAQPLKNRQIKASFK

SEQ ID NO: 5828 - DNA, 777 bp, Artificial Sequence
  source: /note="Description of Artificial Sequence: Synthetic Destabilizing Domain (DD)"
tcccatcactgggggtacggcaaacacaacggatctgagcactggcataaggacttccccattgccaagggagagcgccagtcccctgttgacatcgacactcatacagccaagtatgacccttccctgaagcccctgtctgtttcatatgatcaagcaacttccctgaggatcctcaacaatggtcatgctttcaacgtggagtttgatgactctcaggacaaagcagtgctcaagggaggagccctggatggcacttacagattgattcagtttcactttcactggggttcacttggtggacaaggttcagagcatactgtggataacaagaaatatgctgcagaacttcacttggttcactggaacaccaaatatggggattttgggaaagctgtgcagcaacctgatggactggccgttctaggtatttttttgaaggttggcagcgctaaaccgggccttcagaaagttgttgatgtgctggattccattaaaacaaagggcaagagtgctgacttcactaacttcgatcctcgtggcctccttcctgaatccctggattactggacctacccaggctcactgaccacccctcctcttctggaatgtgtgacctggattgtgctcaaggaacccatcagcgtcagcagcgagcaggtgttgaaattccgtaaacttaacatcaatggggagggtgaacccgaagaattgatggtggacaactggcgcccagctcagccactgaagaacaggcaaatcaaagcttccttcaaa

SEQ ID NO: 5829 - protein, 259 aa, Artificial Sequence
  source: /note="Description of Artificial Sequence: Synthetic Destabilizing Domain (DD)"
SHHWGYGKHNGPEHWHKDFPIAKGERQSPVDIDTHTAKYDPSLKPRSVSYDQATSLRILNNGHAFNVEFDDSQDKAVLKGGPLDGTYRLIQFHFHWGSLDGQGSEHTVDKKKYAAELHLVHWNTKYGDFGKAVQQPDGLAVLGIFLKVGSAKPGLQKVVDVLDSIKTKGKSADFTNFDPRGLLPESLDYWTYPGSLTTPPLLECVTWIVLKEPISVSSEQVLKFRKLNFNGEGEPEELMVDNWRPAQPLKNRQIKASFK

SEQ ID NO: 5830 - DNA, 777 bp, Artificial Sequence
  source: /note="Description of Artificial Sequence: Synthetic Destabilizing Domain (DD)"
tcccatcactgggggtacggcaaacacaacggacctgagcactggcataaggacttccccattgccaagggagagcgccagtcccctgttgacatcgacactcatacagccaagtatgacccttccctgaagccccggtctgtttcctatgatcaagcaacttccctgaggatcctcaacaatggtcatgctttcaacgtggagtttgatgactctcaggacaaagcagtgctcaagggaggacccctggatggcacttacagattgattcagtttcactttcactggggttcacttgatggacaaggttcagagcatactgtggataaaaagaaatatgctgcagaacttcacttggttcactggaacaccaaatatggggattttgggaaagctgtgcagcaacctgatggactggccgttctaggtatttttttgaaggttggcagcgctaaaccgggccttcagaaagttgttgatgtgctggattccattaaaacaaagggcaagagtgctgacttcactaacttcgatcctcgtggcctccttcctgaatccctggattactggacctacccaggctcactgaccacccctcctcttctggaatgtgtgacctggattgtgctcaaggaacccatcagcgtcagcagcgagcaggtgttgaaattccgtaaacttaacttcaatggggagggtgaacccgaagaactgatggtggacaactggcgcccagctcagccactgaagaacaggcaaatcaaagcttccttcaaa

SEQ ID NO: 5831 - protein, 259 aa, Artificial Sequence
  source: /note="Description of Artificial Sequence: Synthetic Destabilizing Domain (DD)"
SHHWGYGKHNGPEHWHKDFPIAKGERQSPVDIDTHTAKYDPSLKPLSVSYDQATSLRILNNDHAFNVEFDDSQDKAVLKGGPLDGTYRLIQFHFHWGSLDGQGSEHTVDKKKYAAELHLVHRNTKYGDFGKAVQQPDGLAVLGIFLKVGSAKPGLQKVVDVLDSIKTKGKSADFTNFDPRGLLPESLDYWTYPGSLTTPPLLECVTWIVLKEPISVSSKQVLKFRKLNFNGEGEPEELMVDNWRPAQPLKNRQIKASFK

SEQ ID NO: 5832 - DNA, 777 bp, Artificial Sequence
  source: /note="Description of Artificial Sequence: Synthetic Destabilizing Domain (DD)"
tcccatcactgggggtacggcaaacacaacggacctgagcactggcataaggacttccccattgccaagggagagcgccagtcccctgttgatatcgacactcatacagccaagtatgacccttccctgaagcccctgtctgtttcctatgatcaagcaacttccctgaggatcctcaacaatgatcatgctttcaacgtggagtttgatgactctcaggacaaagcagtactcaagggaggacccctggatggcacttacagattgattcagtttcactttcactggggttcacttgatggacaaggttcagagcatactgtggataaaaagaaatatgctgcagaacttcacttggttcaccggaacaccaaatatggggattttgggaaagctgtgcagcaacctgatggactggccgttctaggtatttttttgaaggttggcagcgctaaaccgggccttcagaaagttgttgatgtgctggattccattaaaacaaagggcaagagtgctgacttcactaacttcgatcctcgtggcctccttcctgaatccctggattactggacctacccaggctcactgaccacccctcctcttctggaatgtgtgacctggattgtgctcaaggaacccatcagcgtcagcagcaagcaggtgttgaaattccgtaaacttaacttcaatggggagggtgaacccgaagaactgatggtggacaactggcgcccagctcagccactgaagaacaggcaaatcaaagcttccttcaaa

SEQ ID NO: 5833 - protein, 259 aa, Artificial Sequence
  source: /note="Description of Artificial Sequence: Synthetic Destabilizing Domain (DD)"
SHHWGYGKHDGPEHWHKDFPIAKGERQSPVDIDTHTAKYDPSLKPLSVSYDQATSLRILNNGHAFNVKFDDSQDKAVLKGGPLDDTYRLIQFHFHWGSLDGQGSEHTMDKKIYAAELHLVHWNIKYGDFGKAVQQPGGLAVLGIFLKVGSAKPSLQKVVDVLDSIKTKGKSADFTNFDPRGLLPESLDYWTYPGSLTTPPLLECVTWIVLKEPISVSSEQVLKFRKLNFNGEGEPEELMVDNWRPAQPLKNRQIKASFK

SEQ ID NO: 5834 - DNA, 777 bp, Artificial Sequence
  source: /note="Description of Artificial Sequence: Synthetic Destabilizing Domain (DD)"
tcccatcactgggggtacggcaaacacgacggacctgagcactggcataaggacttccccattgccaagggagaacgccagtcccctgttgacatcgacactcatacagccaagtatgacccttccctgaagcccctgtctgtttcctatgatcaagcaacttccctgaggatcctcaacaatggtcatgctttcaacgtgaagtttgatgactctcaggacaaagcagtgctcaagggaggacccctggatgacacttacagattgattcagtttcactttcactggggttcacttgatggacaaggttcagagcatactatggataaaaagatatatgctgcagaacttcacttggttcactggaacatcaaatatggggattttgggaaagctgtgcagcaacctggtggactggccgttctaggtatttttttgaaggttggcagcgctaaaccgagccttcagaaagttgttgatgtgctggattccattaaaacaaagggcaagagtgctgacttcactaacttcgatcctcgtggcctccttcctgaatccctggattactggacctacccaggctcactgaccacccctcctcttctggaatgtgtgacctggattgtgctcaaggaacccatcagcgtcagcagcgagcaggtgttgaaattccgtaaacttaacttcaatggggagggtgaacccgaagaactgatggtggacaactggcgcccagctcagccactgaagaacaggcaaatcaaagcttccttcaaa

SEQ ID NO: 5835 - protein, 259 aa, Artificial Sequence
  source: /note="Description of Artificial Sequence: Synthetic Destabilizing Domain (DD)"
SHHWGYGKHNGPEHWHKDFPIAKGERQSPVDIDTHTAKYDPSLKPLSVSYDQATSLRNLNNGHAFNVEFDDSQDKAVLKGGPLDGTYRLIQFHFHWGSLDRQGSEHTVDKKKYAAELHLVHWNTKYGDFGKAVQQPDGLAVLGIFLKVGSAKPGLQKVVDVLDSIKTKGKSTDFTNFDPRGLLPESLDYWTYPGSLTTPPLLECVTWIVLKEPISVSSEQVLKFRKLNFNGEGEPEELMVDNWRPAQPLKNRQIKASFK

SEQ ID NO: 5836 - DNA, 777 bp, Artificial Sequence
  source: /note="Description of Artificial Sequence: Synthetic Destabilizing Domain (DD)"
tcccatcactgggggtacggcaaacacaacggacctgagcactggcataaggacttccccattgccaagggagagcgccagtcccctgttgacatcgacactcatacagccaagtatgacccatccctgaagcccctgtctgtttcctacgatcaagcaacttccctgaggaacctcaacaatggtcatgctttcaacgtggagtttgatgactctcaggacaaagcagtgctcaagggaggacccctggatggcacttacagattgattcagtttcactttcactggggttcacttgatagacaaggttcagagcatactgtggataaaaagaaatatgctgcagaacttcacttggttcactggaacaccaaatatggggattttgggaaagctgtgcagcaacctgatggactggccgttctaggtatttttttgaaggttggcagcgctaaaccgggccttcagaaagttgttgatgtgctggattccattaaaacaaagggcaagagtactgacttcactaacttcgatcctcgtggcctccttcctgaatccctggattactggacctacccaggctcactgaccacccctcctcttctggaatgtgtgacctggattgtgctcaaggaacccatcagcgtcagcagcgagcaggtgttgaaattccgtaaacttaacttcaatggggagggtgaacccgaagaactgatggtggacaactggcgcccagctcagccactgaagaacaggcaaatcaaagcttccttcaaa

SEQ ID NO: 5837 - protein, 259 aa, Artificial Sequence
  source: /note="Description of Artificial Sequence: Synthetic Destabilizing Domain (DD)"
SHHWGYGKHNGPEHWHKDFPIAKGERQSPVDIDTHTAKYDPSLKPLSVSYDQATSLRILNNGHAFNVEFDDSQDKAVFKGGPLDGTYRLIQFHFHWGSLDGQGSEHTVDKKKYAAELHLVHWNTKYGDFGKAVQQPDGLAVLGIFLKVGSAKPGLQKVVDVLDSIKTKGKSADFTNFDSRGLLPESLDYWTYPGSLTTPPLLECVTWIVLKEPISVSSEQVLKFRKLNFNGEGEPEELMVDNWRPAQPLKNRQIKASFK

SEQ ID NO: 5838 - DNA, 777 bp, Artificial Sequence
  source: /note="Description of Artificial Sequence: Synthetic Destabilizing Domain (DD)"
tcccatcactgggggtacggcaaacacaacggacctgagcactggcataaggatttccccattgccaagggagagcgccagtcccctgttgacatcgacactcatacagccaagtatgacccttccctgaagcccctgtctgtttcctatgatcaagcaacttccctgaggatcctcaacaatggtcatgctttcaacgtggagtttgatgactctcaggacaaagcagtgttcaagggaggacccctggatggcacttacagattgattcagtttcactttcactggggttcacttgatggacaaggttcagagcatactgtggataaaaagaaatatgctgcagaacttcacttggttcactggaacaccaaatatggggattttgggaaagctgtgcagcaacctgatggactggccgttctaggtatttttttgaaggttggcagcgctaaaccgggccttcagaaagttgttgatgtgctggattccattaaaacaaagggcaagagtgctgacttcactaacttcgattctcgtggcctccttcctgaatccctggattactggacctacccaggctcactgaccacccctcctcttctggaatgtgtgacctggattgtgctcaaggaacccatcagcgtcagcagcgagcaggtgttgaaattccgtaaacttaacttcaatggggagggtgaacccgaagaactgatggtggacaactggcgcccagctcagccactgaagaacaggcaaatcaaagcttccttcaaa

SEQ ID NO: 5839 - protein, 259 aa, Artificial Sequence
  source: /note="Description of Artificial Sequence: Synthetic Destabilizing Domain (DD)"
SHHWGYGKHNGPEHWHKDFPIAKGERQSPVDIDTHTAKYDPSLKPLSVSYDQATSLRILNNGHAFNVEFDDFQDKAVLKGGPLDGTYRLIQFHFHWGSLDGQGSEHTVDKKKYAAELHLVHWNTKYGDFGKAVQQPDGLAVLGIFLKVGSAKPGLQKVVDVLDSIKTKGKSADFTNFDPRGLLPESLDYWTYPGSLTTPPLLECVTWIVLKEPISVSSEQVLKFRKLNFNGEGEPEELMVDNWRPAQPLKNRQIKASFK

SEQ ID NO: 5840 - DNA, 777 bp, Artificial Sequence
  source: /note="Description of Artificial Sequence: Synthetic Destabilizing Domain (DD)"
tcccatcactgggggtacggcaaacacaacggacctgagcactggcataaggacttccccattgccaagggagagcgccagtcccctgttgacatcgacactcatacagccaagtatgacccttccctgaagcccctgtctgtttcctatgatcaagcaacttccctgaggatcctcaacaatggtcatgctttcaacgtggagtttgatgactttcaggacaaagcagtgctcaagggaggacccctggatggcacttacagattgattcagtttcactttcactggggttcacttgatggacaaggttcagagcatactgtggataaaaagaaatatgctgcagaacttcacttggttcactggaacaccaaatatggggattttgggaaagctgtgcagcaacctgatggactggccgttctaggtatttttttgaaggttggcagcgctaaaccgggccttcagaaagttgttgatgtgctggattccattaaaacaaagggcaagagtgctgacttcactaacttcgatcctcgtggcctccttcctgaatccctggattactggacctacccaggctcactgaccacccctcctcttctggaatgtgtgacctggattgtgctcaaggaacccatcagcgtcagcagcgagcaggtgttgaaattccgtaaacttaacttcaatggggagggtgaacccgaagaactgatggtggacaactggcgcccagctcagccactgaagaacaggcaaatcaaagcttccttcaaa

SEQ ID NO: 5841 - protein, 259 aa, Artificial Sequence
  source: /note="Description of Artificial Sequence: Synthetic Destabilizing Domain (DD)"
SHHWGYGKHNRPEHWHKDFPIAKGERQSPVDIDTHTAKYDPSLKPLSVSYDQATSLRILNNGHAFNVEFDDSQDKAVLKGGPLDGTYRLIQFHFHWGSLDGQGSEHTVDKKKYAAELHLVHWNTKYGDFGKAVQQPDGLAVLGIFLKVGSAKPGLQKVVDVLDSIKTKGKSADFTNFDPRGLLPESLDYWTYPGSLTTPPLLECVTWIVLKEPISVSSEQVLKFRKLNFNGEGEPEELMVDNWRPAQPLKNRQIKASFK

SEQ ID NO: 5842 - DNA, 777 bp, Artificial Sequence
  source: /note="Description of Artificial Sequence: Synthetic Destabilizing Domain (DD)"
tcccatcactgggggtacggcaaacacaacagacctgagcactggcataaggacttccccattgccaagggagagcgccagtcccctgttgacatcgacactcatacagccaagtatgacccttccctgaagcccctgtctgtttcctatgatcaagcaacttccctgaggatcctcaacaatggtcatgctttcaacgtggagtttgatgactctcaggacaaagcagtgctcaagggaggacccctggatggcacttacagattgattcagtttcactttcactggggttcacttgatggacaaggttcagagcatactgtggataaaaagaaatatgctgcagaacttcacttggttcactggaacaccaaatatggggattttgggaaagctgtgcagcaacctgatggactggccgttctaggtatttttttgaaggttggcagcgctaaaccgggccttcagaaagttgttgatgtgctggattccattaaaacaaagggcaagagtgctgacttcactaacttcgatcctcgtggcctccttcctgaatccctggattactggacctacccaggctcactgaccacccctcctcttctggaatgtgtgacctggattgtgctcaaggaacccatcagcgtcagcagcgagcaggtgttgaaattccgtaaacttaacttcaatggggagggtgaacccgaagaactgatggtggacaactggcgcccagctcagccactgaagaacaggcaaatcaaagcttccttcaaa

SEQ ID NO: 5843 - protein, 259 aa, Artificial Sequence
  source: /note="Description of Artificial Sequence: Synthetic Destabilizing Domain (DD)"
SHHWGYGKHNGPEHWHKDFPIAKGERQSPVDIDTHTAKYDPSLKPLSVSYDQATSLRILNNGHAFNVEFDDSQDKPVLKGGPLDGTYRLIQFHFHWGSLDRQGSEHTVDKKKYAAELHLVHWNTKYGDFGKAVQQPNGLAVLGIFLKVGSAKPGLQKVVDVLDSIKTKGKSADFTNFDPRGLLPESLDYWTYPGSLTTPPLLECVTWIVLKEPISVSSEQVLKFRKLNFNGEGEPEELMVDNWRPAQPLKNRQIKASFK

SEQ ID NO: 5844 - DNA, 777 bp, Artificial Sequence
  source: /note="Description of Artificial Sequence: Synthetic Destabilizing Domain (DD)"
tcccatcactgggggtacggcaaacacaacggacctgagcactggcataaggacttccccattgccaagggagagcgccagtcccctgttgacatcgacactcatacagccaagtatgacccttccctgaagcccctttctgtttcctatgatcaagcaacttccctgaggatcctcaacaatggtcatgctttcaacgtggagtttgatgactctcaggacaaaccagtgctcaagggaggacccctggatggcacttacagattgattcagtttcactttcactggggttcacttgatcgacaaggttcagagcatactgtggataaaaagaaatatgctgcagaacttcacttggttcactggaacaccaaatatggggattttgggaaagctgtgcagcaacctaatggactggccgttctaggtatttttttgaaggttggcagcgctaaaccgggccttcagaaagttgttgatgtgctggattccattaaaacaaagggcaagagtgctgacttcactaacttcgatcctcgtgggctccttcctgaatccctggattactggacctacccaggctcactgaccacccctcctcttctggaatgtgtgacctggattgtgctcaaggaacccatcagcgtcagcagcgagcaggtgttgaaattccgtaaacttaacttcaatggggagggtgaacccgaagaactgatggtggacaactggcgcccagctcagccactgaagaacaggcaaatcaaagcttccttcaaa

SEQ ID NO: 5845 - protein, 259 aa, Artificial Sequence
  source: /note="Description of Artificial Sequence: Synthetic Destabilizing Domain (DD)"
SHHWGYGKHNGPEHWHKDLPIAKGERQSPVDIDTHTAKYDPSLNPLSVSYDQATSLRILNNDHAFNVVFDDSQDKAVLKGGPLDGTYRLIQFHFHWGSLDGQGSEHTVDKKKYAAELHLVHWNTKYGDFGKAVQQPDGLAVLGIFLKVGSAKPGLQKVVDVLDSIKTKGKSADFTNFDPRGLLPESLDYWTYPGSLTTPPLLECVTWIVLKEPISVSSEQVLKFRKLNFIGEGEPEELMVDNWRPAQPLKNRQIKASFK

SEQ ID NO: 5846 - DNA, 777 bp, Artificial Sequence
  source: /note="Description of Artificial Sequence: Synthetic Destabilizing Domain (DD)"
tcccatcactgggggtacggcaaacacaacggacctgagcactggcataaggacctccccattgccaagggagagcgccagtcccctgttgacatcgacactcatacagccaagtatgacccttccctgaatcccctgtctgtttcctatgatcaagcaacttccctgaggatcctcaacaatgatcatgctttcaacgtggtgtttgatgactctcaggacaaagcagtgctcaagggaggacccctggatggcacttacagattgattcagtttcactttcactggggttcacttgatggacaaggttcagagcatactgtggataaaaagaaatatgctgcagaacttcacttggttcactggaacaccaaatatggggattttgggaaagctgtacagcaacctgatggactggccgttctaggtatttttttgaaggttggcagcgctaaaccgggccttcagaaagttgttgatgtgctggattccattaaaacaaagggcaagagtgctgacttcactaacttcgatcctcgtggcctccttcctgaatccctggattactggacctacccaggctcactgaccacccctcctcttctggaatgtgtgacctggattgtgctcaaggaacccatcagcgtcagcagcgagcaggtgttgaaattccgtaaacttaacttcattggggagggtgaacccgaagaactgatggtggacaactggcgcccagctcagccactgaagaacaggcaaatcaaagcttccttcaaa

SEQ ID NO: 5847 - protein, 259 aa, Artificial Sequence
  source: /note="Description of Artificial Sequence: Synthetic Destabilizing Domain (DD)"
SHHWGYGKHNGPEHWHKDFPIAKGERQSPVDIDTHTAKYDPSLKPLSVSYDQATSLRILNNGHAFNVEFDDSQDKAVLKGGPLDGTYRLIQFHFHWGSLDGQGSEHTVDKKKYAAELHLVHWNTKYGDFGKAVQQPDGLAVLGIFLKVGSAKPGLQKVVDVLDSIKTKGKSADFTNFDPRGLLPESLDYWTYPGSLTNPPPLECVTWIVLKEPISVSSEQVLKFRKFNFNGEGEPEELMVDNWRPAQPLKNRQIKASFK

SEQ ID NO: 5848 - DNA, 777 bp, Artificial Sequence
  source: /note="Description of Artificial Sequence: Synthetic Destabilizing Domain (DD)"
tcccatcactgggggtacggaaaacacaacggacctgagcactggcataaggacttccccattgccaagggagagcgccagtcccctgttgacatcgacactcatacagccaagtatgacccttccctgaagcccctgtctgtttcctatgatcaagcaacttccctgaggatcctcaacaatggtcatgctttcaacgtggagtttgatgactctcaggacaaagcagtgctcaagggaggacccctggatggcacttacagattgattcagtttcactttcactggggttcacttgatggacaaggttcagagcatactgtggataaaaagaaatatgctgcagaacttcacttggttcactggaacaccaaatatggggattttgggaaagctgtgcagcaacctgatggactggccgttctaggtatttttttgaaggttggcagcgctaaaccgggccttcagaaagttgttgatgtgctggattccattaaaacaaagggcaagagtgctgacttcactaacttcgatcctcgtggcctccttcctgaatccctggattactggacctacccaggctcactgaccaaccctcctcctctggaatgtgtgacctggattgtgctcaaggaacccatcagcgtcagcagcgagcaggtgttgaaattccgtaaatttaacttcaatggggagggtgaacccgaagaactgatggtggacaactggcgcccagctcagccactgaagaacaggcaaatcaaagcttccttcaaa

SEQ ID NO: 5849 - protein, 259 aa, Artificial Sequence
  source: /note="Description of Artificial Sequence: Synthetic Destabilizing Domain (DD)"
SHHWGYGNHNGPEHWHKDFPIAKGERQSPVDIDTHTAKYDPSLKPLSVSYDQATSLRILNNGHAFNVEFDDSQDKAVLKGGPLDGTYRLIQFHFHWGSLDGQGSEHTVDKKKYAAELHLVYWNTKYGDFGKAVQQPDGLAVLGIFLKVGSAKPGLQKVVDVLDSIKKKGKSADFTNFDPRGLLPESLDYWTYPGSLTTPPLLECVTWIVLKEPISVSSEQVLKFRKLNFNGEGEPEELMVDNWRPAQPLKNRQIKASFK

SEQ ID NO: 5850 - DNA, 777 bp, Artificial Sequence
  source: /note="Description of Artificial Sequence: Synthetic Destabilizing Domain (DD)"
tcccatcactgggggtacggcaatcacaacggacctgagcactggcataaggacttccccattgccaagggagagcgccagtcccctgttgacatcgacactcatacagccaagtatgacccttccctgaagcccctgtctgtttcctatgatcaagcaacttccctgaggatcctcaacaatggtcatgctttcaacgtggagtttgatgactctcaggacaaagcagtgctcaagggaggacccctggatggcacttacagattgattcagtttcactttcactggggttcacttgatggacaaggttcagagcatactgtggataaaaagaaatatgctgcagaacttcacttggtttactggaacaccaaatatggggattttgggaaagctgtgcagcaacctgatggactggccgttctaggtatttttttgaaggttggcagcgctaaaccgggccttcagaaagttgttgatgtgctggattccattaaaaaaaagggcaagagtgctgacttcacgaacttcgatcctcgtggcctccttcctgaatccctggattactggacctacccaggctcactgaccacccctcctcttctggaatgtgtgacctggattgtgctcaaggaacccatcagcgtcagcagcgagcaggtgttgaaattccgtaaacttaacttcaatggggagggtgaacccgaagaactgatggtggacaactggcgcccagctcagccactgaagaacaggcaaatcaaagcttccttcaaa

SEQ ID NO: 5851 - protein, 259 aa, Artificial Sequence
  source: /note="Description of Artificial Sequence: Synthetic Destabilizing Domain (DD)"
SHHWGYGKHNGPEHWHKDFPIAKGERQSPVDIDTHTAKYDPSLKPLSVSYDHATSLRILNNGHAFNVEFDDSQDKAVLKGGPLDGTYRVIHFHFHWGSLDGQGSEHTVDKKKYAAELHLVHWNTKYGDFEKAVQQPDGLAVLGIFLKVGSAKPGLQKVVDVLDSIKTKGKSADFTNFDPRGLLPESLDYWTYPGSLTTPPLLECVTWIVLKEPISVSSEQVLKFRKLNFNGEGEPEELMVDNWRPAQPLKNRQIKASFK

SEQ ID NO: 5852 - DNA, 777 bp, Artificial Sequence
  source: /note="Description of Artificial Sequence: Synthetic Destabilizing Domain (DD)"
tcccatcactgggggtacggcaaacacaacggacctgagcactggcataaggacttccccattgccaagggagagcgccagtcccctgttgacatcgacactcatacagccaagtatgacccttccctgaagcccctgtctgtttcctatgatcatgcaacttccctgaggatcctcaacaatggtcatgctttcaacgtggagtttgatgactctcaggacaaagcagtgctcaagggaggacccctggatggcacttacagagtgattcactttcactttcactggggttcacttgatggacaaggttcagagcatactgtggataaaaagaaatatgctgcagaacttcacttggttcactggaacaccaaatatggggattttgagaaagctgtgcagcaacctgatggactggccgttctaggtatttttttgaaggttggcagcgctaaaccgggccttcagaaagttgttgatgtgctggattccattaaaacaaagggcaagagtgctgacttcactaacttcgatcctcgtggcctccttcctgaatccctggattactggacctacccaggctcactgaccacccctcctcttctggaatgtgtgacctggattgtgctcaaggaacccatcagcgtcagcagcgagcaggtgttgaaattccgtaaacttaacttcaatggggagggtgaacccgaagaactgatggtggacaactggcgcccagctcagccactgaagaacaggcaaatcaaagcttccttcaaa

SEQ ID NO: 5853 - protein, 259 aa, Artificial Sequence
  source: /note="Description of Artificial Sequence: Synthetic Destabilizing Domain (DD)"
SHHWGYGKHNGPEHWHKDFPIAKGERQSPVDIDTHTAKYDPSMKPVSVSYDQATSLRILNKGHAFNVDFDDSQDKAVLKGGPLDGTYRLIQFHFHWGSLDGQGSEHTVDKKKYAAELHLVHWNTKYGDFGKAVQQPDGLAVLGIFLKVGSAKPGLQKVVDVLDSIKTKGKSADFTNFDPRGLLPESLDYWTYPGSLTTPPLLECVTWIVLKEPISVSSEQVLKFRKLNFNGEGEPEELMVDNWRPAQPLKNRQIKASFK

SEQ ID NO: 5854 - DNA, 777 bp, Artificial Sequence
  source: /note="Description of Artificial Sequence: Synthetic Destabilizing Domain (DD)"
tcccatcactgggggtacggcaaacacaacggacctgagcactggcataaggacttccccattgccaagggagagcgccagtcccctgttgacatcgatactcatacagccaagtatgacccttccatgaagcccgtgtctgtttcctatgatcaagcaacttccctgaggatcctcaacaaaggtcatgctttcaacgtggattttgatgactctcaggacaaagcagtgctcaagggaggacccctggatggcacttacagattgattcagtttcactttcactggggttcacttgatggacaaggttcagagcatactgtggataaaaagaaatatgctgcagaacttcacttggttcactggaacaccaaatatggggattttgggaaagctgtgcagcaacctgatggactggccgttttaggtatttttttgaaggttggcagcgctaaaccgggccttcagaaagttgttgatgtgctggattccattaaaacaaagggcaagagtgctgacttcactaacttcgatcctcgtggcctccttcctgaatccctggattactggacctacccaggctcactgaccacccctcctcttctggaatgtgtgacctggattgtgctcaaggaacccatcagcgtcagcagcgagcaggtgttgaaattccgtaaacttaacttcaatggggagggtgaacccgaagaactgatggtggacaactggcgcccagctcagccactgaagaacaggcaaatcaaagcttccttcaaa

SEQ ID NO: 5855 - protein, 259 aa, Artificial Sequence
  source: /note="Description of Artificial Sequence: Synthetic Destabilizing Domain (DD)"
SHHWGYGKHNGPEHWHKDLPIAKGERQSPVDIDTHTAKYDPSLNPLSVSYDQATSLRILNNGHAFNVEFDDSQDKAVLKGGPLDGTYRLIQFHFHWGSLDGQRSEHTVDKKKYAVELHLVHWNTKYGDFGKAVQQPDGLAVLGIFLKVGSAKPGLQKVVDVLDSIKTKGKSADFTNFDPRGLLPESLDYWTYPGSLTTPPLLECVTWIVLKEPISVSSEQVLKFRKLNFNGEGEPEELMVDNWRPAQPLKNRQIKASFK

SEQ ID NO: 5856 - DNA, 777 bp, Artificial Sequence
  source: /note="Description of Artificial Sequence: Synthetic Destabilizing Domain (DD)"
tcccatcactgggggtacggcaaacacaacggacctgagcactggcataaggacctccccattgccaagggagagcgccagtcccctgttgacatcgacactcatacagccaagtatgacccttccctgaatcccctgtctgtttcctatgatcaagcaacttccctgaggatcctcaacaatggtcatgctttcaacgtggagtttgatgactctcaggacaaagcagtgctcaagggaggacccctggatggcacttacagattgattcagtttcactttcactggggttcacttgatggacaacgttcagagcatactgtggataaaaagaaatatgctgtagaacttcacttggttcactggaacaccaaatatggggattttgggaaagctgtgcagcaacctgatggactggccgttctaggtatttttttgaaggttggcagcgctaaaccgggccttcagaaagttgttgatgtgctggattccattaaaacaaagggcaagagtgctgacttcactaacttcgatcctcgtggcctccttcctgaatccctggattactggacctacccaggctcactgaccacccctcctcttctggaatgtgtgacctggattgtgctcaaggaacccatcagcgtcagcagcgagcaggtattgaaattccgtaaacttaacttcaatggggagggtgaacccgaagaactgatggtggacaactggcgcccagctcagccactgaagaacaggcaaatcaaagcttccttcaaa

SEQ ID NO: 5857 - protein, 259 aa, Artificial Sequence
  source: /note="Description of Artificial Sequence: Synthetic Destabilizing Domain (DD)"
SHHWGYGKHNGPEHWHKDFPIAKGERQSPVDIDTHTAKYDPSLKPLSVSYDQATSLRILNNGHAFNVEFDDSQVKAVLKGGPLDGTYRLIQFHFHWGSLDGQGSEHTVDKKKYAAELHLVHWNTKYGDFGKAVQQPDGLAVLGIFLKVGSAKPGLQKVVDVLDSIKTNGKSADFTNFDPRGLLPESLDYWTYPGSLTTPPLLECVTWIVLKEPISVSSEQVLKFRKLNFNGEGEPEELMVDNWRPAQPLKNRQIKASLK

SEQ ID NO: 5858 - DNA, 777 bp, Artificial Sequence
  source: /note="Description of Artificial Sequence: Synthetic Destabilizing Domain (DD)"
tcccatcactgggggtacggcaaacacaacggacctgagcactggcataaggacttccccattgccaagggagagcgccagtcccctgttgacatcgacactcatacagccaagtatgacccttccctgaagcccctgtctgtttcctatgatcaagcaacttccctgaggatcctcaacaatggtcatgctttcaacgtggagtttgatgactctcaggtcaaagcagtgctcaagggaggacccttggatggcacttacagattgattcagtttcactttcactggggttcacttgatggacaaggttcagagcatactgtggataaaaagaaatatgctgcagaacttcacttggttcactggaacaccaaatatggggattttgggaaagctgtgcagcaacctgatggactggccgttctaggtatttttttgaaggttggcagcgctaaaccgggccttcagaaagttgttgatgtgctggattccattaaaacaaatggcaagagtgctgacttcactaacttcgatcctcgtggcctccttcctgaatccttggattactggacctacccaggctcactgaccacccctcctcttctggaatgtgtgacctggattgtgctcaaggaacccatcagcgtcagcagcgagcaggtgttgaaattccgtaaacttaacttcaatggggagggtgaacccgaagaactgatggtggacaactggcgcccagctcagccactgaagaacaggcaaatcaaagcttccctcaaa

SEQ ID NO: 5859 - protein, 259 aa, Artificial Sequence
  source: /note="Description of Artificial Sequence: Synthetic Destabilizing Domain (DD)"
SHHWGYGKHNGPEHWHKDFPIAKGERQSPVDIDTHTAKYDPSLKPLSVSYDQATSLRILNNGHAFNVEFDDSQDKAVLKGGPLDGTYRLIQFHFHWGSLDGQGSEHTVDKKKYAAELHLVHWNTKYGDFGKAVQQPDGLAVLGIFLKVGSAKPGLQKVVDVLDSIKTKGKSADFTNFDPRGLLPESLDYWTYPGSLTTPPLLECVSWIVLKEPISVSSEQALKFRKLNFDGEGEPEELMVDNWRPAQPLKNRQIKASFK

SEQ ID NO: 5860 - DNA, 777 bp, Artificial Sequence
  source: /note="Description of Artificial Sequence: Synthetic Destabilizing Domain (DD)"
tcccatcactgggggtacggcaaacacaacggacctgagcattggcataaggacttccccattgccaagggagagcgccagtcccctgttgacatcgacactcatacagccaagtatgacccttccctgaagcccctgtctgtttcctatgatcaagcaacttccctgaggatcctcaacaatggtcatgctttcaacgtggagtttgatgactctcaggacaaagcagtgctcaagggaggacccctggatggcacttacagattgattcagtttcactttcactggggttcacttgatggacaaggttcagagcatactgtggataaaaagaaatatgctgcagaacttcacttggttcactggaacaccaaatatggggattttgggaaagctgtgcagcaacctgatggactggccgttctaggtatttttttgaaggttggcagcgctaaaccgggccttcagaaagttgttgatgtgctggattccattaaaacaaagggcaagagtgctgacttcactaacttcgatcctcgtggcctccttcctgaatccctggattactggacctacccaggctcactgactacccctcctcttctggaatgtgtgtcctggattgtgctcaaggaacccatcagcgtcagcagcgagcaggcgttgaaattccgtaaacttaacttcgatggggagggtgaacccgaagaactgatggtggacaactggcgcccagctcagccactgaagaacaggcaaatcaaagcttccttcaaa

SEQ ID NO: 5861 - protein, 259 aa, Artificial Sequence
  source: /note="Description of Artificial Sequence: Synthetic Destabilizing Domain (DD)"
SHHWGYGKHNGPEHWHKDFPIAKGERQSPVDIDTHTAKYDPSLKPLSVSYDQATSLRFLNNGHAFNVEFDDSQDKAVLKGGPLDGTYRLIQFHFHWGSLDGQGSEHTVDKKKYAAELHLVHWNTKYGDFGKAVQQPDGLAVLGIFLKVGSAKPGLQKVVDVLDSIKTKGKSADFTNFDPRGLLPESLDYWTYPGSLTTPPLLECMTWIVLKEPISVSSEQVLKFRKLNFNREGEPEELMVDNWRPAQPLKNRQIKASFK

SEQ ID NO: 5862 - DNA, 777 bp, Artificial Sequence
  source: /note="Description of Artificial Sequence: Synthetic Destabilizing Domain (DD)"
tcccatcactgggggtacggcaaacacaacggacctgagcactggcataaggacttccccattgccaagggagagcgccagtcccctgttgacatcgacactcatacagccaagtatgacccttccctgaagcccctgtctgtttcctatgatcaagcaacttccctgaggttcctcaacaatggtcatgctttcaacgtggagtttgatgactctcaggacaaagcagtgctcaagggaggacccctggatggcacttacagattgattcagtttcactttcactggggctcacttgatggacaaggttcagagcatactgtggataaaaagaaatatgctgcagaacttcacttggttcactggaacaccaaatatggggattttgggaaagctgtgcagcaacctgatggactggccgttctaggtatttttttgaaggttggcagcgctaaaccgggccttcagaaagttgttgatgtgctggattccattaaaacaaagggcaagagtgctgacttcactaacttcgatcctcgtggcctccttcctgaatccctggattactggacctacccaggctcactgaccacccctcctcttctggaatgtatgacctggattgtgctcaaggaacccatcagcgtcagcagcgagcaggtgttgaaattccgtaaacttaacttcaatagggagggtgaacccgaagaactgatggtggacaactggcgcccagctcagccactgaagaacaggcaaatcaaagcttccttcaaa

SEQ ID NO: 5863 - protein, 259 aa, Artificial Sequence
  source: /note="Description of Artificial Sequence: Synthetic Destabilizing Domain (DD)"
SHHWGYGKHNGAEHWHKDFPIAKGERQSPVDIDTHTAKYDPSLKPLSVSYDQATSLRILNNGHAFNVEFDDSQDKAVLKGGPLDGTYRLIQFHFHWGSLDGQGSEHTVDKKKYAAELHLVHWNTKYGDFGKTVQQPDGLAVLGIFLKVGSAKPGLQKVVDVLDSIKTKGKSADFTNFDPRGLLPESLDYWTYPGSLTTPPLLECVTWIVLKEPISVSSEQVLKFRKLNFNGEGEPEELMVDNWRPAQPLKNRQIKASFK

SEQ ID NO: 5864 - DNA, 777 bp, Artificial Sequence
  source: /note="Description of Artificial Sequence: Synthetic Destabilizing Domain (DD)"
tcccatcactgggggtacggcaaacacaacggagctgagcactggcataaggacttccccattgccaagggagagcgccagtcccctgttgacatcgacactcatacagccaagtatgacccttccctgaagcccctgtctgtttcctatgatcaagcaacttccctgaggatcctcaacaatggtcatgctttcaacgtggagtttgatgactctcaggacaaagcagtgctcaagggaggacccctggatggcacttacagattgattcagtttcactttcactggggttcacttgatggacaaggttcagagcatactgtggataaaaagaaatatgctgcagaacttcacttggttcactggaacaccaaatatggggattttgggaaaactgtgcagcaacctgatggactggccgttctaggtatttttttgaaggttggcagcgctaaaccgggccttcagaaagttgttgatgtgctggattccattaaaacaaagggcaagagtgctgacttcactaacttcgatcctcgtggcctccttcctgaatccctggattactggacctacccaggctcactgaccacccctcctcttctggaatgtgtgacctggattgtgctcaaggaacccatcagcgtcagcagcgagcaggtgttgaaattccgtaaacttaacttcaatggggagggtgaacccgaagaactgatggtggacaactggcgcccagctcagccactgaagaacaggcaaatcaaagcttccttcaaa

SEQ ID NO: 5865 - protein, 259 aa, Artificial Sequence
  source: /note="Description of Artificial Sequence: Synthetic Destabilizing Domain (DD)"
SHHWGYGKHNGPEHWHKDFPIAKGERQSPVDIDTHTAKYDPSLKPLSVSYDQATSLRILRNGHAFNVEFDDSQDKAVLMGGPLDGTYRLIQFHFHWGSLDGQGSEHTVDKKKYAAELHLVHWNTKYGDFGKAVQQPDGLAVLGIFLKVGSAKPGLQKVVDVLDSIKTKGKSADFTNFDPRGLLPESLDYWTYPGSLTTPPLLECVTWIVLNEPISVSSEQVLKFRKLNFTGEGEPEELMVDNWRPAQPPKNRQIKASFK

SEQ ID NO: 5866 - DNA, 777 bp, Artificial Sequence
  source: /note="Description of Artificial Sequence: Synthetic Destabilizing Domain (DD)"
tcccatcactgggggtacggcaaacacaacggacctgagcactggcataaggacttccccattgccaagggagagcgccagtcccctgttgacatcgacactcatacagccaagtatgacccttccctgaagcccctgtctgtttcctatgatcaagcaacttccctgaggatcctcaggaatggtcatgctttcaacgtggagtttgatgactctcaggacaaagcagtgctcatgggaggacccctggatggcacttacagattgattcagtttcactttcactggggttcacttgatggacaaggttcagagcatactgtggataaaaagaaatatgctgcagaacttcacttggttcactggaacaccaaatatggggattttggaaaagctgtgcagcaacctgatggactggccgttctaggtatttttttgaaggttggcagcgctaaaccgggccttcagaaagttgttgatgtgctggattccattaaaacaaagggcaagagtgctgacttcactaacttcgatcctcgtggcctccttcctgaatccctggattactggacctacccaggctcactgaccacccctcctcttctggaatgtgtgacctggattgtgctcaatgaacccatcagcgtcagcagcgagcaggtgttgaaattccgtaaacttaacttcactggggagggtgaacccgaagaactgatggtggacaactggcgcccagctcagccaccgaagaacaggcaaatcaaagcttccttcaaa

SEQ ID NO: 5867 - protein, 259 aa, Artificial Sequence
  source: /note="Description of Artificial Sequence: Synthetic Destabilizing Domain (DD)"
SHHWGYGKHNGPEHWHKDFPIAKGERQSPVDIDTHTAKYDPSLKPLSVSYDQATSLRILNNDHAFNVVFDDSQDKAVLKGGPLDGTYRLIQFHFHWGSLDGQGSEHTVDKKKYAAELHLVHWNTKYGDFGKAVQQPDGLAVLGIFLKVGSAKPGLQKVVDVLDSIKTKGKSADFTNFDPRGLLPESLDYWTYPGSLTTPPLLECVTWIVLKEPISVSSEQVLKFRKLNFIGEGEPEELMVDNWRPAQPLKNRQIKASFK

SEQ ID NO: 5868 - DNA, 777 bp, Artificial Sequence
  source: /note="Description of Artificial Sequence: Synthetic Destabilizing Domain (DD)"
tcccatcactgggggtacggcaaacacaacggacctgagcactggcataaggacttccccattgccaagggagagcgccagtcccctgttgacatcgacactcatacagccaagtatgacccttccctgaagcccctgtctgtttcctatgatcaagcaacttccctgaggatcctcaacaatgatcatgctttcaacgtggtgtttgatgactctcaggacaaagcagtgctcaagggaggacccctggatggcacttacagattgattcagtttcactttcactggggttcacttgatggacaaggttcagagcatactgtggataaaaagaaatatgctgcagaacttcacttggttcactggaacaccaaatatggggattttgggaaagctgtacagcaacctgatggactggccgttctaggtatttttttgaaggttggcagcgctaaaccgggccttcagaaagttgttgatgtgctggattccattaaaacaaagggcaagagtgctgacttcactaacttcgatcctcgtggcctccttcctgaatccctggattactggacctacccaggctcactgaccacccctcctcttctggaatgtgtgacctggattgtgctcaaggaacccatcagcgtcagcagcgagcaggtgttgaaattccgtaaacttaacttcattggggagggtgaacccgaagaactgatggtggacaactggcgcccagctcagccactgaagaacaggcaaatcaaagcttccttcaaa

SEQ ID NO: 5869 - protein, 259 aa, Artificial Sequence
  source: /note="Description of Artificial Sequence: Synthetic Destabilizing Domain (DD)"
SHHWGYGKHNGPEHWHKDFPIAKGERQSPVDIDTHTAKYDPSLKPLSVSYDQATSLRNLNNGHAFNVEFDDSQDKAVLKGGPLDGTYILIQFHFHWGSLDGQGSEHTVDKKKYAAELHLVHWNTKYGDFGKAVQQPDGLAVLGIFLKVGSAKPGLQKVVDVLDSIKTKGKSADFTNFDPRGLLPESLDYWTYPGSLTTPPLLECVTWIVLKEPISVSSEQVLKFRKLNFNGEGEPEELMVDNWRPAQPLKNRQIKASFK

SEQ ID NO: 5870 - DNA, 777 bp, Artificial Sequence
  source: /note="Description of Artificial Sequence: Synthetic Destabilizing Domain (DD)"
tcccatcactgggggtacggcaaacacaacggacctgagcactggcataaggacttccccattgccaagggagagcgccagtcccctgttgacatcgacactcatacagccaagtatgacccttccctgaagcccctgtctgtttcctatgatcaagcaacttccctgaggaacctcaacaatggtcatgctttcaacgtggagtttgatgactctcaggacaaagcagtgctcaagggaggacccctggatggcacttacatattgattcagtttcactttcactggggttcacttgatggacaaggttcagagcatactgtggataaaaagaaatatgctgcagaacttcacttggttcactggaacaccaaatatggggattttgggaaagctgtgcagcaacctgatggactggccgttctaggtatttttttgaaggttggcagcgctaaaccgggccttcagaaagttgttgatgtgctggattccattaaaacaaagggcaagagtgctgacttcactaacttcgatcctcgtggcctccttcctgaatccctggattactggacctacccaggctcactgaccacccctcctcttctggaatgtgtgacctggattgtgctcaaggaacccatcagcgtcagcagcgagcaggtgttgaaattccgtaaacttaacttcaatggggagggtgaacccgaagaactgatggtggacaactggcgcccagctcagccactgaagaacaggcaaatcaaagcttccttcaaa

SEQ ID NO: 5871 - protein, 259 aa, Artificial Sequence
  source: /note="Description of Artificial Sequence: Synthetic Destabilizing Domain (DD)"
SHHWGYGKHNGPEHWHKDFPIAKGERQSPVDIDTHTAKYDPSLKPLSVSYDQATSLRILNNGHNFNVEFDDSQDKAVLKGGPLDDTYRLIQFHFHWGSLDGQGSEHTVDKKKYAAELHLVHWNTKYGDFRKAVQQPDGLAVLGIFLKVGSAKPDLQNVVDALDSIKTKDKSADFTNFDPRGLLPESLDYWTYPGSLTTPPLLECVTWIVLKEPISVSSEQVLKFRKLNFNGEGELEELMVDNWRPAQPLKNRQIKASFK

SEQ ID NO: 5872 - DNA, 777 bp, Artificial Sequence
  source: /note="Description of Artificial Sequence: Synthetic Destabilizing Domain (DD)"
tcccatcactgggggtacggcaaacacaacggacctgagcactggcataaggacttccccattgccaagggagagcgccagtcccctgttgacatcgacactcatacagccaagtatgacccttccctgaagcccctgtctgtttcctatgatcaagcaacttccctgaggatcctcaacaatggtcataatttcaacgtggagtttgatgactctcaggacaaagcagtgctcaagggaggacccctggatgacacttacagattgattcagtttcactttcactggggttcacttgatggacaaggttcagagcatactgtggataaaaagaaatatgctgcagaacttcacttggttcactggaacaccaaatatggggattttaggaaagctgtgcagcaacctgatggactggccgttctaggtatttttttgaaggttggcagcgctaaaccggaccttcagaatgttgttgatgcgctggattccattaaaacaaaggacaagagtgctgacttcactaacttcgatcctcgtggcctccttcctgaatccctggattactggacctacccaggctcactgaccacccctcctcttctggaatgtgtgacctggattgtgctcaaggaacccatcagcgtcagcagcgagcaggtgttgaaattccgtaaacttaacttcaatggggagggtgaactcgaagaactgatggtggacaactggcgcccagctcagccactgaagaacaggcaaatcaaagcttccttcaaa

SEQ ID NO: 5873 - protein, 259 aa, Artificial Sequence
  source: /note="Description of Artificial Sequence: Synthetic Destabilizing Domain (DD)"
SHHWGYGKHNRPEYWHKVFPIAKGERQSPVDIDTHTAKYDPSLKPLSVSYDQATSLRILNNGHAFNVEFDDSQDKAVLKGGPLDGTYRLIQFHFHWGSLDGQGSEHTVDKKKYAAELHLVHWNTKYGDFGKAVQQPDGLAVLGIFLKVGSAKPGLQKVVDVLDSIKTKGKSADFTNFDPRGLLPESLDYWTYPGSLTTPPLLECVTWIVLKEPISVSSEQVLKFRKLNFNGEGEPEELMVDNWRPAQPLKNRQIKASFK

SEQ ID NO: 5874 - DNA, 777 bp, Artificial Sequence
  source: /note="Description of Artificial Sequence: Synthetic Destabilizing Domain (DD)"
tcccatcactgggggtacggcaaacacaaccgacctgagtactggcataaggtcttccccattgccaagggagagcgccagtcccctgttgacatcgacactcatacagccaagtatgacccttccctgaagcccctgtctgtttcctatgatcaagcaacttcactgagaatcctcaacaatggtcatgctttcaacgtggagtttgatgactctcaggacaaagcagtgctcaagggaggacccctggatggcacttacagattgattcagtttcactttcactggggttcacttgatggacaaggttcagagcatactgtggataaaaagaaatatgctgcagaacttcacttggttcactggaacaccaaatatggggattttgggaaagctgtgcagcaacctgatggactggccgttctaggtatttttttgaaggttggcagcgctaaaccgggccttcagaaagttgttgatgtgctggattccattaaaacaaagggcaagagtgctgacttcactaacttcgatcctcgtggcctccttcctgaatccctggattactggacctacccaggctcactgaccacccctcctcttctggaatgtgtgacctggattgtgctcaaggaacccatcagcgtcagcagcgagcaggtgttgaaattccgtaaacttaacttcaatggggagggtgaacccgaagaactgatggtggacaactggcgcccagctcagccactgaagaacaggcaaatcaaagcttccttcaaa

SEQ ID NO: 5875 - protein, 259 aa, Artificial Sequence
  source: /note="Description of Artificial Sequence: Synthetic Destabilizing Domain (DD)"
SHHWGYGKHNGPEHWHKDFPIAKGERQSPVDIDTHTAKYDPSLKPLSVSYDQATSLRILNNGHAFNVEFDDSQDKAVLKGGPLDGTYRLIQFHFHWGSLDGQGSEHTVDKKKYAAELHLVHWNTKYGDFGKAVQQPDGLAVLGIFLKVGSAKPGHQKVVDVLDSIKTKGKCADFTNYDPRGLLPDSLDYWTYPGSLTTPPLLECVTWIVLKEPISVSSEQVLKFRKLNFNGEGEPEELMVDNWRPAQPLKNRQIKASFK

SEQ ID NO: 5876 - DNA, 777 bp, Artificial Sequence
  source: /note="Description of Artificial Sequence: Synthetic Destabilizing Domain (DD)"
tcccatcactgggggtacggcaaacacaacggacctgagcactggcataaggacttccccattgccaagggagagcgccagtcccctgttgacatcgacactcatacagccaagtatgacccttccctgaagcccctgtctgtttcctatgatcaagcaacttccctgaggatcctcaacaatggtcatgctttcaacgtggagtttgatgactctcaggacaaagcagtgctcaagggaggacccctggatggcacttacagattgattcagtttcactttcactggggttcacttgatggacaaggttcagagcatactgtggataaaaagaaatatgctgcagaacttcacttggttcactggaacaccaaatatggggattttgggaaagctgtgcagcaacctgatggactggccgttctaggtatttttttgaaggttggcagcgctaaaccgggccatcagaaagttgttgatgtgctggattccattaaaacaaagggcaagtgtgctgacttcactaactacgatcctcgtggcctccttcctgattccctggattactggacctacccaggctcactgaccacccctcctcttctggaatgtgtgacctggattgtgctcaaggaacccatcagcgtcagcagcgagcaggtgttgaaattccgtaaacttaacttcaatggggagggtgaacccgaagaactgatggtggacaactggcgcccagctcagccactgaagaacaggcaaatcaaagcttccttcaaa

SEQ ID NO: 5877 - protein, 259 aa, Artificial Sequence
  source: /note="Description of Artificial Sequence: Synthetic Destabilizing Domain (DD)"
SHHWGYGKHNGPEHWHKDFPIAKGERQSPVDIDTHTAKYDPSLKPLSVSYDQATSLRILNNGHVFNVEFDDSQDKAVLKGGPLDGTYRLIQFHYHWGSLDGQGSGQTVDKKKYAAELHLVHWNTKYGDFGKAVQQPDGLAVLGMFLKVGSAKPGLQKVVDVLDSIKTKGKSADITNFDPRGLLPESLDYWTYPGSLTTPPLLECVTWIVLKEPISVSSEQVLKFRKLNFNGEGEPEELMVDNWRPAQPLKNRQIKASFK

SEQ ID NO: 5878 - DNA, 777 bp, Artificial Sequence
  source: /note="Description of Artificial Sequence: Synthetic Destabilizing Domain (DD)"
tcccatcactgggggtacggcaaacacaacggacctgagcactggcataaggacttccccattgccaagggagagcgccagtcccctgttgacatcgacactcatacagccaagtatgacccttccctgaagcccctgtctgtttcctatgatcaagcaacttccctgaggatcctcaacaatggtcatgttttcaacgtggagtttgatgactctcaggacaaagcagtgctcaagggaggacccctggatggcacttacagattgattcagtttcactatcactggggttcacttgatggacaaggttcagggcaaactgtggataaaaagaaatatgctgcagaacttcacttggttcactggaacaccaaatatggggattttgggaaagctgtgcagcaacctgatggactggccgttctaggtatgtttttgaaggttggcagcgctaaaccgggccttcagaaagttgttgatgtgctggattccattaaaacaaagggcaagagtgctgacatcactaacttcgatcctcgtggcctccttcctgaatccctggattactggacctacccaggctcactgaccacccctcctcttctggaatgtgtgacctggattgtgctcaaggaacccatcagcgtcagcagcgagcaggtgttgaaattccgtaaacttaacttcaatggagagggtgaacccgaagaactgatggtggacaactggcgcccagctcagccactgaagaacaggcaaatcaaagcttccttcaaa

SEQ ID NO: 5879 - protein, 259 aa, Artificial Sequence
  source: /note="Description of Artificial Sequence: Synthetic Destabilizing Domain (DD)"
SHHWGYGKHNGPEHWHKDFPIAKGERQSPVDIDTHTAKYDPSLKPLSVSYDQATSLRILNNGHAFNVEFDDSQDKAVLKGGPLDGTYRLIQFHFHWGSLDGQGSEHTVDKKKYAAELHLVHWNTKYGDFGKAVQQPDGLAVLGIFLKVGSAKPGLQKVVDVLDSIKTKGKSADFTNFDPRGLLPESLDYWTYPGSPTTPPLLECVTWIVLKEPISVSSEQVLKFRKLNFNGEGEPEELMVDNWRPAQPLKNRQIKASFK

SEQ ID NO: 5880 - DNA, 777 bp, Artificial Sequence
  source: /note="Description of Artificial Sequence: Synthetic Destabilizing Domain (DD)"
tcccatcactgggggtacggcaaacacaacggacctgagcactggcataaggacttccccattgccaagggagagcgtcagtcccctgttgacatcgacactcatacagccaagtatgacccttccctgaagcccctgtctgtttcctatgatcaagcaacttccctgaggatcctcaacaatggtcatgctttcaacgtggagtttgatgactctcaggacaaagcagtgctcaagggaggacccctggatggcacttacagattgattcagtttcactttcactggggttcacttgatggacaaggttcagagcatactgtggataaaaagaaatatgctgcagaacttcacttggttcactggaacaccaaatatggggattttgggaaagctgtgcagcaacctgatggactggccgttctaggtatttttttgaaggttggcagcgctaaaccgggccttcagaaagttgttgatgtgctggattccattaaaacaaagggcaagagtgctgacttcactaacttcgatcctcgtggcctccttcctgaatccctggattactggacctacccaggctcaccgaccacccctcctcttctggaatgtgtgacctggattgtgctcaaggaacccatcagcgtcagcagcgagcaggtgttgaaattccgtaaacttaacttcaatggggagggtgaacccgaagaactgatggtggacaactggcgcccagctcagccactgaagaacaggcaaatcaaagcttccttcaaa

SEQ ID NO: 5881 - protein, 259 aa, Artificial Sequence; identical to SEQ ID NO: 5867
  source: /note="Description of Artificial Sequence: Synthetic Destabilizing Domain (DD)"

SEQ ID NO: 5882 - DNA, 777 bp, Artificial Sequence; identical to SEQ ID NO: 5868
  source: /note="Description of Artificial Sequence: Synthetic Destabilizing Domain (DD)"

SEQ ID NO: 5883 - protein, 141 aa, Artificial Sequence
  source: /note="Description of Artificial Sequence: Synthetic Destabilizing Domain (DD)"
SHHWGYGKHNEPEHWHKDFPIAKGERQSPVDIDTHTVKYDPSLKPLSVSYDQATSLRILNNGHVFNVEFDDSQDKAVLKGGPLDGTYRLIQFHFHWVHLMDKVQSILWIKRNMLQNFTWFTGTPNMGILGELCSNLMDWPF

SEQ ID NO: 5884 - protein, 117 aa, Artificial Sequence
  source: /note="Description of Artificial Sequence: Synthetic Destabilizing Domain (DD)"
VFFLKVGSAKPGQQKVVDALDSIKTKGKSADFTNFDPRGLLPESLDYWTYPGSLTTPPLLECVTWIVLKEPISVSSEQVLKFRKLNFNGEGEPEELMVDNWRPAQPLKNRQIKASFK

SEQ ID NO: 5885 - DNA, 777 bp, Artificial Sequence
  source: /note="Description of Artificial Sequence: Synthetic Destabilizing Domain (DD)"
tcccatcactgggggtacggcaaacacaacgaacctgagcactggcataaggacttccccattgccaagggagagcgccagtcccctgttgacatcgacactcatacagtcaagtatgacccttccctgaagcccctgtctgtttcctatgatcaagcaacttccctgaggatcctcaacaatggtcatgttttcaacgtggagtttgatgactctcaggacaaagcagtgctcaagggaggacccctggatggcacttacagattgattcagtttcactttcactgggttcacttgatggacaaggttcagagcatactgtggataaaaagaaatatgctgcagaatttcacttggttcactggaacaccaaatatggggattttgggagagctgtgcagcaacctgatggactggccgttctaggtattttttttgaaggttggcagcgctaaaccgggccaacagaaagttgttgatgcgctggattccattaaaacaaagggcaagagtgctgacttcactaacttcgatcctcgtggcctccttcctgaatccctggattactggacctacccaggctcactgaccacccctcctcttctggaatgtgtgacctggattgtgctcaaggaacccatcagcgtcagcagcgagcaggtgttgaaattccgtaaacttaacttcaatggggagggtgaacccgaagaactgatggtggacaactggcgcccagctcagccactgaagaacaggcaaatcaaagcttccttcaaa

SEQ ID NO: 5886 - protein, 189 aa, Artificial Sequence
  source: /note="Description of Artificial Sequence: Synthetic Destabilizing Domain (DD)"
SHHWGYGKHNGPEHWHKDLPIAKGERQSPVDIDTHTAKYDPSLNPLSVSYDQATSLRILNNGHAFNVEFDDSQDKAVLKGGPLDGTYRLIQFHFHWGSLDGQRSEHTVDKKKYAVELHLVHWNTKYGDFGKAVQQPDGLAVLGIFLKVGSAKPGLQKVVDVLDSIKTKGKSGDFTNFDPRGLLPESLDY

SEQ ID NO: 5887 - protein, 69 aa, Artificial Sequence
  source: /note="Description of Artificial Sequence: Synthetic Destabilizing Domain (DD)"
TYPGSLTTPPLLECVTWIVLKEPISVSSEQVLKFRKLNFNGEGEPEELMVDNWRPAQPLKNRQIKASFK

SEQ ID NO: 5888 - DNA, 777 bp, Artificial Sequence
  source: /note="Description of Artificial Sequence: Synthetic Destabilizing Domain (DD)"
tcccatcactgggggtacggcaaacacaacggacctgagcactggcataaggacctccccattgccaagggagagcgccagtcccctgttgacatcgacactcatacagccaagtatgacccttccctgaatcccctgtctgtttcctatgatcaagcaacttccctgaggatcctcaacaatggtcatgctttcaacgtggagtttgatgactctcaggacaaagcagtgctcaagggaggacccctggatggcacttacagattgattcagtttcactttcactggggttcacttgatggacaacgttcagagcatactgtggataaaaagaaatatgctgtagaacttcacttggttcactggaacaccaaatatggggattttgggaaagctgtgcagcaacctgatggactggccgttctaggtatttttttgaaggttggcagcgctaaaccgggccttcagaaagttgttgatgtgctggattccattaaaacaaagggcaagagtggtgacttcactaacttcgatcctcgtggcctccttcctgaatccctggattactgaacctacccaggctcactgaccacccctcctcttctggaatgtgtgacctggattgtgctcaaggaacccatcagcgtcagcagcgagcaggtgttgaaattccgtaaacttaacttcaatggggagggtgaacccgaagaactgatggtggacaactggcgcccagctcagccactgaagaacaggcaaatcaaagcttccttcaaa

SEQ ID NO: 5889 - protein, 189 aa, Artificial Sequence
  source: /note="Description of Artificial Sequence: Synthetic Destabilizing Domain (DD)"
SHHWGYGKHNGPEHWDKDFPIAKGERQSSVDIDTHTAKYDPSLKPLSVSYDQATSLRILNNGHAFNVEFDDSQDKAVLKVGPLDGTYRLIQFHFHWGSLDGQGSEHTVDKKKYAAELHLVHWNTKYGDFGRAVQQPDGLAVLGIFLKVGIDKPGLQKVVDVLDSIKTKGKSGDFTNFDPRGLLPESLDY

SEQ ID NO: 5890 - DNA, 777 bp, Artificial Sequence
  source: /note="Description of Artificial Sequence: Synthetic Destabilizing Domain (DD)"
tcccatcactgggggtacggcaaacacaacggacctgagcattgggataaggacttccccattgccaagggagagcgccagtcctctgttgacatcgacactcatacagccaagtatgacccttccctgaagcccctgtctgtttcctatgatcaagcaacttccctgaggatcctcaacaatggtcatgctttcaacgtggagtttgatgactctcaggacaaagcagtgctcaaggtaggacccctggatggcacttacagattgattcagtttcactttcactggggttcacttgatggacaaggttcagagcatactgtggataaaaagaaatatgctgcagaacttcacttggttcactggaacaccaaatatggggattttgggagagctgtgcagcaacctgatggactggccgttctaggtatttttttgaaggttggcatcgataaaccgggccttcagaaagttgttgatgtgctggattccattaaaacaaagggcaagagtggtgacttcactaacttcgatcctcgtggcctccttcctgaatccctggattactgaacctacccaggctcactgaccacccctcctcttctggaatgtgtgacctggattgtgctcaaggaacccatcagcgtcagcagcgagcaggtattgaaattccgtaaacttaacttcaatggggagggtgaacccgaagaactgatggtggacaactggcgcccagctcagccactgaagaacaggcaaatcaaagcttccttcaaa

SEQ ID NO: 5891 - DNA, 777 bp, Artificial Sequence
  source: /note="Description of Artificial Sequence: Synthetic Destabilizing Domain (DD)"
tcccatcactgggggtacggcaaacacaacggacctgagcattgggataaggacttccccattgccaagggagagcgccagtcctctgttgacatcgacactcatacagccaagtatgacccttccctgaagcccctgtctgtttcctatgatcaagcaacttccctgaggatcctcaacaatggtcatgctttcaacgtggagtttgatgactctcaggacaaagcagtgctcaaggtaggacccctggatggcacttacagattgattcagtttcactttcactggggttcacttgatggacaaggttcagagcatactgtggataaaaagaaatatgctgcagaacttcacttggttcactggaacaccaaatatggggattttgggagagctgtgcagcaacctgatggactggccgttctaggtatttttttgaaggttggcatcgataaaccgggccttcagaaagttgttgatgtgctggattccattaaaacaaagggcaagagtggtgacttcactaacttcgatcctcgtggcctccttcctgaatccctggattactgaacctacccaggctcactgaccacccctcctcttctggaatgtgtgacctggattgtgctcaaggaacccatcagcgtcagcagcgagcaggtgttgaaattccgtaaacttaacttcaatggggagggtgaacccgaagaactgatggtggacaactggcgcccagctcagccactgaagaacaggcaaatcaaagcttccttcaaa

SEQ ID NO: 5892 - protein, 88 aa, Artificial Sequence
  source: /note="Description of Artificial Sequence: Synthetic Destabilizing Domain (DD)"
SHHWGYGKHNGPEHWHKDFPIAKGERQSPVDIDTHTAKYDPSLKPLSVSYDQATSLRNLNNGHAFNVEFDDSQDKAVLKGGPLDGTYR

SEQ ID NO: 5893 - protein, 170 aa, Artificial Sequence
  source: /note="Description of Artificial Sequence: Synthetic Destabilizing Domain (DD)"
IQFHFHWGSLDRQGSEHTVDKKKYAAELHLVHWNTKYGDFGKAVQQPDGLAVLGIFLKVGSAKPGLQKVVDVLDSIKTKGKSADFTNFDPRGLLPESLDYWTYPGSLTTPPLLECVTWIVLKEPISVSSEQVLKFRKLNFNGEGEPEELMVDNWRPAQPLKNRQIKASFK

SEQ ID NO: 5894 - DNA, 777 bp, Artificial Sequence
  source: /note="Description of Artificial Sequence: Synthetic Destabilizing Domain (DD)"
tcccatcactgggggtacggcaaacacaacggacctgagcactggcataaggacttccccattgccaagggagagcgccagtcccctgttgacatcgacactcatacagccaagtatgacccatccctgaagcccctgtctgtttcctacgatcaagcaacttccctgaggaacctcaacaatggtcatgctttcaacgtggagtttgatgactctcaggacaaagcagtgctcaagggaggacccctggatggcacttacagatagattcagtttcactttcactggggttcacttgatagacaaggttcagagcatactgtggataaaaagaaatatgctgcagaacttcacttggttcactggaacaccaaatatggggattttgggaaagctgtgcagcaacctgatggactggccgttctaggtatttttttgaaggttggcagcgctaaaccgggccttcagaaagttgttgatgtgctggattccattaaaacaaagggcaagagtgctgacttcactaacttcgatcctcgtggcctccttcctgaatccctggattactggacctacccaggctcactgaccacccctcctcttctggaatgtgtgacctggattgtgctcaaggaacccatcagcgtcagcagcgagcaggtgttgaaattccgtaaacttaacttcaatggggagggtgaacccgaagaactgatggtggacaactggcgcccagctcagccactgaagaacaggcaaatcaaagcttccttcaaa

SEQ ID NO: 5895 - protein, 242 aa, Artificial Sequence
  source: /note="Description of Artificial Sequence: Synthetic Destabilizing Domain (DD)"
SHHWGYGKHNGPEHWHKDFPIAKGERQSPVDIDIHTAKYDPSLKPLSVSYDQATSLRILNNGHAFNVEFDDSQDKAVLKGGPLDGTYRLIQFHFHWGSLDGQGSEHTVDKKKHAAELHLVHWNTKYGDFGKAVQQPDGLAVLGIFLKVGSAKLGLQKVVVVLDSIKTKGKSADFTNFDPRGLLPESLDYWTYPGSLTTAPLLECVTWIVLKEPISVSSERVLKLRKLNFNGDGEPEELMVDN

SEQ ID NO: 5896 - protein, 16 aa, Artificial Sequence
  source: /note="Description of Artificial Sequence: Synthetic Destabilizing Domain (DD)"
RPAQPLKNRQIKASFK

SEQ ID NO: 5897 - DNA, 777 bp, Artificial Sequence
  source: /note="Description of Artificial Sequence: Synthetic Destabilizing Domain (DD)"
tcccatcactgggggtacggcaaacacaacggacctgagcactggcataaggacttccccattgccaagggagagcgccagtcccctgttgacatcgacattcatacagccaagtatgacccttccctgaagcccctgtctgtttcctatgatcaagcaacttccctgaggatcctcaacaatggtcatgctttcaacgtggagtttgatgactctcaggataaagcagtgctcaagggaggacccctggatggcacttacagattgattcagtttcactttcactggggttcacttgatggacaaggttcagagcatactgtggataaaaagaaacatgctgcagaacttcacttggttcactggaacaccaaatatggggattttgggaaagctgtgcagcaacctgatggactggccgttctaggtatttttttgaaggttggcagcgctaaactgggccttcagaaagttgttgttgtgctggattccattaaaacaaagggcaagagtgctgacttcactaacttcgatcctcgtggcctccttcctgaatccctggattactggacctacccaggctcactgaccaccgctcctcttctggaatgtgtgacctggattgtgctcaaggaacccatcagcgtcagcagcgagcgggtgttgaaattacgtaaacttaacttcaatggggacggtgaacccgaagaactgatggtggacaactgacgcccagctcagccactgaagaacaggcaaatcaaagcttccttcaaa

SEQ ID NO: 5898 - protein, 188 aa, Artificial Sequence
  source: /note="Description of Artificial Sequence: Synthetic Destabilizing Domain (DD)"
SHHWGYGKHNGPEHWHKDFPIAKGERQSPVDIDTHTAKYDPSLKPLSVSYDQATSLRILNNGHAFNVEFDDSQDKAVLKGGPLDGTYRLIQFHFHWGSLDGQGLEHTVDKKKYAAELHLVHWNTKYGDFGKAVQQPDGVAVLGIFLKVGSAKPCLQKVVDVLDSIKTKGKSADFTNFDPRGLLPESLD

SEQ ID NO: 5899 - protein, 70 aa, Artificial Sequence
  source: /note="Description of Artificial Sequence: Synthetic Destabilizing Domain (DD)"
WTYPGSLTTPPLLECVTWIVLKEPISVSSEQVLKFRKLNFNGEGEPEELMVDNWRPAQPLKNRQIKASFK

SEQ ID NO: 5900 - DNA, 777 bp, Artificial Sequence
  source: /note="Description of Artificial Sequence: Synthetic Destabilizing Domain (DD)"
tcccatcactgggggtacggcaaacacaacggacctgagcactggcataaggacttccccattgccaagggagagcgccagtcccctgttgacatcgacactcatacagccaagtatgacccttccctgaagcccctgtctgtttcctatgatcaagcaacttccctgaggatcctcaacaatggtcatgctttcaacgtggagtttgatgactctcaggacaaagcagtgctcaagggaggacccctagatggcacttacagattgattcagtttcactttcactggggttcacttgatggacaaggtttagagcatactgtggataaaaagaaatatgctgcagaacttcacttggttcactggaacaccaaatatggggattttgggaaagctgtgcagcaacctgatggagtggccgttctaggtatttttttgaaggttggcagcgctaaaccgtgccttcagaaagttgttgatgtgctggattccattaaaacaaagggcaagagtgctgacttcactaacttcgatcctcgtggcctccttcctgaatccctggattagtggacctacccaggctcactgaccacccctcctcttctggaatgtgtgacctggattgtgctcaaggaacccatcagcgtcagcagcgagcaggtgttgaaattccgtaaacttaacttcaatggggagggtgaacccgaagaactgatggtggacaactggcgcccagctcagccactgaagaacaggcaaatcaaagcttccttcaaa

SEQ ID NO: 5901 - protein, 242 aa, Artificial Sequence
  source: /note="Description of Artificial Sequence: Synthetic Destabilizing Domain (DD)"
SHHWGYGKHNGPEHWHKDFPIAKGERQSPVDIDIHTAKYDPSLKPLSVSYDQATSLRILNNGHAFNVEFDDSQDKAVLKGGPLDGTYRLIQFHFHWGSLDGQGSEHTVDKKKHAAELHLVHWNTKYGDFGKAVQQPDGLAVLGIFLKVGSAKLGLQKVVVVLDSIKTKGKSADFTNFDPRGLLPESLDYWTYPGSLTTAPLLECVTWIVLKEPISVSSEQVLKLRKLNFNGDGEPEELMVDN

SEQ ID NO: 5902 - DNA, 777 bp, Artificial Sequence
  source: /note="Description of Artificial Sequence: Synthetic Destabilizing Domain (DD)"
tcccatcactgggggtacggcaaacacaacggacctgagcactggcataaggacttccccattgccaagggagagcgccagtcccctgttgacatcgacattcatacagccaagtatgacccttccctgaagcccctgtctgtttcctatgatcaagcaacttccctgaggatcctcaacaatggtcatgctttcaacgtggagtttgatgactctcaggataaagcagtgctcaagggaggacccctggatggcacttacagattgattcagtttcactttcactggggttcacttgatggacaaggttcagagcatactgtggataaaaagaaacatgctgcagaacttcacttggttcactggaacaccaaatatggggattttgggaaagctgtgcagcaacctgatggactggccgttctaggtatttttttgaaggttggcagcgctaaactgggccttcagaaagttgttgttgtgctggattccattaaaacaaagggcaagagtgctgacttcactaacttcgatcctcgtggcctccttcctgaatccctggattactggacctacccaggctcactgaccaccgctcctcttctggaatgtgtgacctggattgtgctcaaggaacccatcagcgtcagcagcgagcaggtgttgaaattacgtaaacttaacttcaatggggacggtgaacccgaagaactgatggtggacaactgacgcccagctcagccactgaagaacaggcaaatcaaagcttccttcaaa

SEQ ID NO: 5903 - protein, 165 aa, Artificial Sequence
  source: /note="Description of Artificial Sequence: Synthetic Destabilizing Domain (DD)"
SHHWGYGKHNGPEHWHKDFPIAKGERQSPVDIDTHTAKYDPSLKPLSVSYDQATSLRILNNGHAFNVEFDDSQDKAVLKGGPLDGTYRLIQFHFHWGSLDGQGSEHTVDKKKYAAELHLVHWNTKYGDFGKAVQQPDGLAVLGIFLKVGSAKPGLQKVVDVLDSI

SEQ ID NO: 5904 - protein, 45 aa, Artificial Sequence
  source: /note="Description of Artificial Sequence: Synthetic Destabilizing Domain (DD)"
TKGKSADFTNFDPHGLLPESLDYWTYPGSLTTPPLLECVTWIVLK

SEQ ID NO: 5905 - protein, 47 aa, Artificial Sequence
  source: /note="Description of Artificial Sequence: Synthetic Destabilizing Domain (DD)"
PISLSSEQVLKFRKHNFNGEGEPEELMVDNWRPAQPLKNRQIKASFK

SEQ ID NO: 5906 - DNA, 777 bp, Artificial Sequence
  source: /note="Description of Artificial Sequence: Synthetic Destabilizing Domain (DD)"
tcccatcactgggggtacggcaaacacaacggacctgagcactggcataaggacttccccattgccaagggagagcgccagtcccctgttgacatcgacactcatacagccaagtatgacccttccctgaagcccctgtctgtttcctatgatcaagcaacttccctgaggatcctcaacaatggtcatgctttcaacgtggaatttgatgactctcaggacaaagcagtgctcaagggaggacccctggatggcacttacagattgattcagtttcactttcactggggttcacttgatggacaaggttcagagcatactgtggataaaaagaaatatgctgcagaacttcacttggttcactggaacaccaaatatggggattttgggaaagctgtgcagcaacctgatggactggccgttctaggtatttttttgaaggttggcagcgctaaaccgggccttcagaaagttgttgatgtgctggattccatttaaacaaagggcaagagtgctgacttcactaacttcgatcctcatggcctccttcctgaatccctggattactggacctacccaggctcactgaccacccctcctcttctggaatgtgtgacctggattgtgctcaagtaacccatcagcctcagcagcgagcaggtgttgaaattccgtaagcataacttcaatggggagggtgaacccgaagaactgatggtggacaactggcgcccagctcagccactgaagaacaggcaaatcaaagcttccttcaaa

SEQ ID NO: 5907 - protein, 29 aa, Artificial Sequence
  source: /note="Description of Artificial Sequence: Synthetic Destabilizing Domain (DD)"
TKGKSADFTNFDPHGLLPESLDYWTYQAH

SEQ ID NO: 5908 - protein, 8 aa, Artificial Sequence
  source: /note="Description of Artificial Sequence: Synthetic Destabilizing Domain (DD)"
PPLLFWNV

SEQ ID NO: 5909 - protein, 16 aa, Artificial Sequence
  source: /note="Description of Artificial Sequence: Synthetic Destabilizing Domain (DD)"
PGLCSRNPSASAASRC

SEQ ID NO: 5910 - protein, 15 aa, Artificial Sequence
  source: /note="Description of Artificial Sequence: Synthetic Destabilizing Domain (DD)"
NSVNLTSMGRLNPKN

SEQ ID NO: 5911 - protein, 10 aa, Artificial Sequence
  source: /note="Description of Artificial Sequence: Synthetic Destabilizing Domain (DD)"
WWTTGAQLSH

SEQ ID NO: 5912 - protein, 9 aa, Artificial Sequence
  source: /note="Description of Artificial Sequence: Synthetic Destabilizing Domain (DD)"
RTGKSKLPS

SEQ ID NO: 5913 - DNA, 776 bp, Artificial Sequence
  source: /note="Description of Artificial Sequence: Synthetic Destabilizing Domain (DD)"
tcccatcactgggggtacggcaaacacaacggacctgagcactggcataaggacttccccattgccaagggagagcgccagtcccctgttgacatcgacactcatacagccaagtatgacccttccctgaagcccctgtctgtttcctatgatcaagcaacttccctgaggatcctcaacaatggtcatgctttcaacgtggaatttgatgactctcaggacaaagcagtgctcaagggaggacccctggatggcacttacagattgattcagtttcactttcactggggttcacttgatggacaaggttcagagcatactgtggataaaaagaaatatgctgcagaacttcacttggttcactggaacaccaaatatggggattttgggaaagctgtgcagcaacctgatggactggccgttctaggtatttttttgaaggttggcagcgctaaaccgggccttcagaaagttgttgatgtgctggattccatttaaacaaagggcaagagtgctgacttcactaacttcgatcctcatggcctccttcctgaatccctggattactggacctaccaggcccactgaccacccctcctcttctggaatgtgtgacctggattgtgctcaaggaacccatcagcgtcagcagcgagcaggtgttgaaattccgtaaacttaacttcaatggggaggctgaacccgaagaactgatggtggacaactggcgcccagctcagccactgaagaacaggcaaatcaaagcttccttcaaa

SEQ ID NO: 5914 - protein, 115 aa, Artificial Sequence
  source: /note="Description of Artificial Sequence: Synthetic Destabilizing Domain (DD)"
SHHWGYGKHNGHEHWHKDFPIAKGERQSPVDIDTHTAKYDPSLKPLSVSYDQATSLRILNNGHAFNVEFDDSQDKAVLKGGPLDGTYRLIQFHFHWGSLDGQGSEHTVDKKKYAA

SEQ ID NO: 5915 - protein, 79 aa, Artificial Sequence
  source: /note="Description of Artificial Sequence: Synthetic Destabilizing Domain (DD)"
LHLVHWNTKYGDFGKAVQQPDGLAVLGIFLKVSSAKPGLQKVVDVLDSIKTKGKSADFTNFDPRGLFLNPWITGPTQAH

SEQ ID NO: 5916 - protein, 4 aa, Artificial Sequence
  source: /note="Description of Artificial Sequence: Synthetic Destabilizing Domain (DD)"
PGLC

SEQ ID NO: 5917 - protein, 11 aa, Artificial Sequence
  source: /note="Description of Artificial Sequence: Synthetic Destabilizing Domain (DD)"
RNPSASAASRC

SEQ ID NO: 5918 - protein, 15 aa, Artificial Sequence
  source: /note="Description of Artificial Sequence: Synthetic Destabilizing Domain (DD)"
NSVNLTSMGRVNPKN

SEQ ID NO: 5919 - DNA, 776 bp, Artificial Sequence
  source: /note="Description of Artificial Sequence: Synthetic Destabilizing Domain (DD)"
tcccatcactgggggtacggcaaacacaacggacatgagcactggcataaggacttccccattgccaagggagagcgccagtcccctgttgacatcgacactcatacagccaagtatgacccttccctgaagcccctgtctgtttcctatgatcaagcaacttccctgaggatcctcaacaatggtcatgctttcaacgtggagtttgatgactctcaggacaaagcagtgctcaagggaggacccctggatggcacttacagattgattcagtttcactttcactggggttcacttgatggacaaggttcagagcatactgtggataaaaagaaatatgctgcataacttcacttggttcactggaacaccaaatatggggattttgggaaagctgtgcagcaacctgatggactggccgttctaggtatttttttgaaggttagcagcgctaaaccgggccttcagaaagttgttgatgtgctggattccattaaaacaaagggcaagagtgctgacttcactaacttcgatcctcgtggcctcttcctgaatccctggattactggacctacccaggctcactgaccacccctcctcttctggaatgtgtgacctggattgtgctgaaggaacccatcagcgtcagcagcgagcaggtgttgaaattccgtaaacttaacttcaatggggagggtgaacccgaagaactgatggtggacaactggcgcccagctcagccactgaagaacaggcaaatcaaagcttccttcaaa

SEQ ID NO: 5920 - protein, 151 aa, Artificial Sequence
  source: /note="Description of Artificial Sequence: Synthetic Destabilizing Domain (DD)"
SHHWGYGKHNGPEHWHKDFPIAKGERQSPVDIDTHTAKYDPSLKPLSVSYDQATSLRILNNGHAFNVEFDDSQDKAVLKGGPLDGTYRLIQFHFHWGSLDGQGSEHTVDKKKYAAELHLVHWNTKYGDFGKTVQQPDGLAVLGIFFEGWQR

SEQ ID NO: 5921 - protein, 7 aa, Artificial Sequence
  source: /note="Description of Artificial Sequence: Synthetic Destabilizing Domain (DD)"
TGPSESC

SEQ ID NO: 5922 - protein, 5 aa, Artificial Sequence
  source: /note="Description of Artificial Sequence: Synthetic Destabilizing Domain (DD)"
CAGFH

SEQ ID NO: 5923 - protein, 6 aa, Artificial Sequence
  source: /note="Description of Artificial Sequence: Synthetic Destabilizing Domain (DD)"
NKGQEC

SEQ ID NO: 5924 - protein, 8 aa, Artificial Sequence
  source: /note="Description of Artificial Sequence: Synthetic Destabilizing Domain (DD)"
LRSSWPPS

SEQ ID NO: 5925 - protein, 40 aa, Artificial Sequence
  source: /note="Description of Artificial Sequence: Synthetic Destabilizing Domain (DD)"
IPGLLDLPRLTDHPSSSGMCDLDCAQGTHQRQQRAGVEIP

SEQ ID NO: 5926 - protein, 5 aa, Artificial Sequence
  source: /note="Description of Artificial Sequence: Synthetic Destabilizing Domain (DD)"
LQWGG

SEQ ID NO: 5927 - protein, 25 aa, Artificial Sequence
  source: /note="Description of Artificial Sequence: Synthetic Destabilizing Domain (DD)"
TRRTDGGQLAPSSATEEQANQSFLQ

SEQ ID NO: 5928 - DNA, 778 bp, Artificial Sequence
  source: /note="Description of Artificial Sequence: Synthetic Destabilizing Domain (DD)"
tcccatcactgggggtacggcaaacacaacggacctgagcactggcataaggacttccccattgccaagggagagcgccagtcccctgttgacatcgacactcatacagccaagtatgacccttccctgaagcccctgtctgtttcctatgatcaagcaacttccctgaggatcctcaacaatggtcatgctttcaacgtggagtttgatgactctcaggacaaagcagtgctcaagggaggacccctggatggcacttacagattgattcagtttcactttcactggggttcacttgatggacaaggttcagagcatactgtggataaaaagaaatatgctgcagaacttcacttggttcactggaacaccaaatatggggattttgggaaaactgtgcagcaacctgatggactggccgttctaggtattttttttgaaggttggcagcgctaaaccgggccttcagaaagttgttgatgtgctggattccattaaaacaaagggcaagagtgctgacttcactaacttcgatcctcgtggcctccttcctgaatccctggattactggacttacccaggctcactgaccacccctcctcttctggaatgtgtgacctggattgtgctcaaggaacccatcagcgtcagcagcgagcaggtgttgaaattccgtaaacttaacttcaatggggagggtgaacccgaagaactgatggtggacaactggcgcccagctcagccactgaagaacaggcaaatcaaagcttccttcaaa

SEQ ID NO: 5929 - protein, 151 aa, Artificial Sequence
  source: /note="Description of Artificial Sequence: Synthetic Destabilizing Domain (DD)"
SHHWGYGKHNGPEHWHKDLPIAKGERQSPVDIDTHTAKYDPSLNPLSVSYDQATSLRILNNGHAFNVEFDDSQDKAVLKGGPLDGTYRLIQFHFHWGSLDGQRSEHTVDKKKYAVELHLVHWNTKYGDFGKAVQQPDGLAVLGIFFEGWQR

SEQ ID NO: 5930 - protein, 40 aa, Artificial Sequence
  source: /note="Description of Artificial Sequence: Synthetic Destabilizing Domain (DD)"
IPGLLDLPRLTDHPSSSGMCDLDCAQGTHQRQQRAGIEIP

SEQ ID NO: 5931 - DNA, 778 bp, Artificial Sequence
  source: /note="Description of Artificial Sequence: Synthetic Destabilizing Domain (DD)"
tcccatcactgggggtacggcaaacacaacggacctgagcactggcataaggacctccccattgccaagggagagcgccagtcccctgttgacatcgacactcatacagccaagtatgacccttccctgaatcccctgtctgtttcctatgatcaagcaacttccctgaggatcctcaacaatggtcatgctttcaacgtggagtttgatgactctcaggacaaagcagtgctcaagggaggacccctggatggcacttacagattgattcagtttcactttcactggggttcacttgatggacaacgttcagagcatactgtggataaaaagaaatatgctgtagaacttcacttggttcactggaacaccaaatatggggattttgggaaagctgtgcagcaacctgatggactggccgttctaggtattttttttgaaggttggcagcgctaaaccgggccttcagaaagttgttgatgtgctggattccattaaaacaaagggcaagagtgctgacttcactaacttcgatcctcgtggcctccttcctgaatccctggattactggacctacccaggctcactgaccacccctcctcttctggaatgtgtgacctggattgtgctcaaggaacccatcagcgtcagcagcgagcaggtattgaaattccgtaaacttaacttcaatggggagggtgaacccgaagaactgatggtggacaactggcgcccagctcagccactgaagaacaggcaaatcaaagcttccttcaaa

SEQ ID NO: 5932 - protein, 42 aa, Artificial Sequence
  source: /note="Description of Artificial Sequence: Synthetic Destabilizing Domain (DD)"
SHHWGYGKHKDLNTGIRTSPLPRESASPLLTSTLIQPSMTLP

SEQ ID NO: 5933 - protein, 12 aa, Artificial Sequence
  source: /note="Description of Artificial Sequence: Synthetic Destabilizing Domain (DD)"
SPCLFPMIKQLP

SEQ ID NO: 5934 - protein, 32 aa, Artificial Sequence
  source: /note="Description of Artificial Sequence: Synthetic Destabilizing Domain (DD)"
GSSTMVMLSTWSLMTLRTKQCSREDPWMALTD

SEQ ID NO: 5935 - protein, 52 aa, Artificial Sequence
  source: /note="Description of Artificial Sequence: Synthetic Destabilizing Domain (DD)"
FSFTFTGVHLMDKVQSILWIKRNMLQNFTWFTGTPNMGILGKLCSNLMDWPF

SEQ ID NO: 5936 - protein, 49 aa, Artificial Sequence
  source: /note="Description of Artificial Sequence: Synthetic Destabilizing Domain (DD)"
RLAALNRAFRKLLMCWIPLKQRARVLTSLTSILVASFVNPWITGPTQAH

SEQ ID NO: 5937 - protein, 16 aa, Artificial Sequence
  source: /note="Description of Artificial Sequence: Synthetic Destabilizing Domain (DD)"
PGLCSWNPSASAASRC

SEQ ID NO: 5938 - protein, 15 aa, Artificial Sequence
  source: /note="Description of Artificial Sequence: Synthetic Destabilizing Domain (DD)"
NYVNLTSMGRVNPKN

SEQ ID NO: 5939 - protein, 10 aa, Artificial Sequence
  source: /note="Description of Artificial Sequence: Synthetic Destabilizing Domain (DD)"
RWTTGALLSH

SEQ ID NO: 5940 - DNA, 776 bp, Artificial Sequence
  source: /note="Description of Artificial Sequence: Synthetic Destabilizing Domain (DD)"
tcccatcactgggggtacggcaaacacaaggacctgaacactggcataaggacttccccattgccaagggagagcgccagtcccctgttgacatcgacactcatacagccaagtatgacccttccctgaagcccctgtctgtttcctatgatcaagcaacttccctgaggatcctcaacaatggtcatgctttcaacgtggagtttgatgactctcaggacaaagcagtgctcaagggaggacccctggatggcacttacagattgattcagtttcactttcactggggttcacttgatggacaaggttcagagcatactgtggataaaaagaaatatgctgcagaacttcacttggttcactggaacaccaaatatggggattttgggaaagctgtgcagcaacctgatggactggccgttctaggtatttttttgaaggttggcagcgctaaaccgggccttcagaaagttgttgatgtgctggattccattaaaacaaagggcaagagtgctgacttcactaacttcgatcctcgtggcctccttcgtgaatccctggattactggacctacccaggctcactgaccacccctcctcttctggaatgtgtgacctggattgtgctcatggaacccatcagcgtcagcagcgagcaggtgttgaaattacgtaaacttaacttcaatggggagggtgaacccgaagaactgaaggtggacaactggcgccctgctcagccactgaagaacaggcaaatcaaagcttccttcaaa

SEQ ID NO: 5941 - protein, 142 aa, Artificial Sequence
  source: /note="Description of Artificial Sequence: Synthetic Destabilizing Domain Template"
MSHHWGYGKHNGPEHWHKDFPIAKGERQSPVDIDTHTAKYDPSLKPLSVSYDQATSLRILNNGHAFNVEFDDSQDKAVLKGGPLDGTYRLIQFHFHWGSLDGQGSEHTVDKKKYAAELHLVHWNTKYGDFGKAVQQPDGLAV

SEQ ID NO: 5942 - protein, 141 aa, Artificial Sequence
  source: /note="Description of Artificial Sequence: Synthetic Destabilizing Domain Template"
SHHWGYGKHNGPEHWHKDFPIAKGERQSPVDIDTHTAKYDPSLKPLSVSYDQATSLRILNNGHAFNVEFDDSQDKAVLKGGPLDGTYRLIQFHFHWGSLDGQGSEHTVDKKKYAAELHLVHWNTKYGDFGKAVQQPDGLAV

SEQ ID NO: 5943 - protein, 190 aa, Artificial Sequence
  source: /note="Description of Artificial Sequence: Synthetic Destabilizing Domain Template"
MSHHWGYGKHNGPEHWHKDFPIAKGERQSPVDIDTHTAKYDPSLKPLSVSYDQATSLRILNNGHAFNVEFDDSQDKAVLKGGPLDGTYRLIQFHFHWGSLDGQGSEHTVDKKKYAAELHLVHWNTKYGDFGKAVQQPDGLAVLGIFLKVGSAKPGLQKVVDVLDSIKTKGKSADFTNFDPRGLLPESLDY

SEQ ID NO: 5944 - protein, 189 aa, Artificial Sequence
  source: /note="Description of Artificial Sequence: Synthetic Destabilizing Domain Template"
SHHWGYGKHNGPEHWHKDFPIAKGERQSPVDIDTHTAKYDPSLKPLSVSYDQATSLRILNNGHAFNVEFDDSQDKAVLKGGPLDGTYRLIQFHFHWGSLDGQGSEHTVDKKKYAAELHLVHWNTKYGDFGKAVQQPDGLAVLGIFLKVGSAKPGLQKVVDVLDSIKTKGKSADFTNFDPRGLLPESLDY

SEQ ID NO: 5945 - protein, 89 aa, Artificial Sequence
  source: /note="Description of Artificial Sequence: Synthetic Destabilizing Domain Template"
MSHHWGYGKHNGPEHWHKDFPIAKGERQSPVDIDTHTAKYDPSLKPLSVSYDQATSLRILNNGHAFNVEFDDSQDKAVLKGGPLDGTYR

SEQ ID NO: 5946 - protein, 88 aa, Artificial Sequence
  source: /note="Description of Artificial Sequence: Synthetic Destabilizing Domain Template"
SHHWGYGKHNGPEHWHKDFPIAKGERQSPVDIDTHTAKYDPSLKPLSVSYDQATSLRILNNGHAFNVEFDDSQDKAVLKGGPLDGTYR

SEQ ID NO: 5947 - protein, 243 aa, Artificial Sequence
  source: /note="Description of Artificial Sequence: Synthetic Destabilizing Domain Template"
MSHHWGYGKHNGPEHWHKDFPIAKGERQSPVDIDTHTAKYDPSLKPLSVSYDQATSLRILNNGHAFNVEFDDSQDKAVLKGGPLDGTYRLIQFHFHWGSLDGQGSEHTVDKKKYAAELHLVHWNTKYGDFGKAVQQPDGLAVLGIFLKVGSAKPGLQKVVDVLDSIKTKGKSADFTNFDPRGLLPESLDYWTYPGSLTTPPLLECVTWIVLKEPISVSSEQVLKFRKLNFNGEGEPEELMVDN

SEQ ID NO: 5948 - protein, 242 aa, Artificial Sequence
  source: /note="Description of Artificial Sequence: Synthetic Destabilizing Domain Template"
SHHWGYGKHNGPEHWHKDFPIAKGERQSPVDIDTHTAKYDPSLKPLSVSYDQATSLRILNNGHAFNVEFDDSQDKAVLKGGPLDGTYRLIQFHFHWGSLDGQGSEHTVDKKKYAAELHLVHWNTKYGDFGKAVQQPDGLAVLGIFLKVGSAKPGLQKVVDVLDSIKTKGKSADFTNFDPRGLLPESLDYWTYPGSLTTPPLLECVTWIVLKEPISVSSEQVLKFRKLNFNGEGEPEELMVDN

SEQ ID NO: 5949 - protein, 166 aa, Artificial Sequence
  source: /note="Description of Artificial Sequence: Synthetic Destabilizing Domain Template"
MSHHWGYGKHNGPEHWHKDFPIAKGERQSPVDIDTHTAKYDPSLKPLSVSYDQATSLRILNNGHAFNVEFDDSQDKAVLKGGPLDGTYRLIQFHFHWGSLDGQGSEHTVDKKKYAAELHLVHWNTKYGDFGKAVQQPDGLAVLGIFLKVGSAKPGLQKVVDVLDSI

SEQ ID NO: 5950 - DNA, 495 bp, Artificial Sequence
  source: /note="Description of Artificial Sequence: Synthetic Destabilizing Domain Template"
tcccatcactgggggtacggcaaacacaacggacctgagcactggcataaggacttccccattgccaagggagagcgccagtcccctgttgacatcgacactcatacagccaagtatgacccttccctgaagcccctgtctgtttcctatgatcaagcaacttccctgaggatcctcaacaatggtcatgctttcaacgtggaatttgatgactctcaggacaaagcagtgctcaagggaggacccctggatggcacttacagattgattcagtttcactttcactggggttcacttgatggacaaggttcagagcatactgtggataaaaagaaatatgctgcagaacttcacttggttcactggaacaccaaatatggggattttgggaaagctgtgcagcaacctgatggactggccgttctaggtatttttttgaaggttggcagcgctaaaccgggccttcagaaagttgttgatgtgctggattccatt

SEQ ID NO: 5951 - protein, 116 aa, Artificial Sequence
  source: /note="Description of Artificial Sequence: Synthetic Destabilizing Domain Template"
MSHHWGYGKHNGPEHWHKDFPIAKGERQSPVDIDTHTAKYDPSLKPLSVSYDQATSLRILNNGHAFNVEFDDSQDKAVLKGGPLDGTYRLIQFHFHWGSLDGQGSEHTVDKKKYAA

SEQ ID NO: 5952 - protein, 115 aa, Artificial Sequence
  source: /note="Description of Artificial Sequence: Synthetic Destabilizing Domain Template"
SHHWGYGKHNGPEHWHKDFPIAKGERQSPVDIDTHTAKYDPSLKPLSVSYDQATSLRILNNGHAFNVEFDDSQDKAVLKGGPLDGTYRLIQFHFHWGSLDGQGSEHTVDKKKYAA

SEQ ID NO: 5953 - protein, 152 aa, Artificial Sequence
  source: /note="Description of Artificial Sequence: Synthetic Destabilizing Domain Template"
MSHHWGYGKHNGPEHWHKDFPIAKGERQSPVDIDTHTAKYDPSLKPLSVSYDQATSLRILNNGHAFNVEFDDSQDKAVLKGGPLDGTYRLIQFHFHWGSLDGQGSEHTVDKKKYAAELHLVHWNTKYGDFGKAVQQPDGLAVLGIFLKVGSA

SEQ ID NO: 5954 - protein, 151 aa, Artificial Sequence
  source: /note="Description of Artificial Sequence: Synthetic Destabilizing Domain Template"
SHHWGYGKHNGPEHWHKDFPIAKGERQSPVDIDTHTAKYDPSLKPLSVSYDQATSLRILNNGHAFNVEFDDSQDKAVLKGGPLDGTYRLIQFHFHWGSLDGQGSEHTVDKKKYAAELHLVHWNTKYGDFGKAVQQPDGLAVLGIFLKVGSA

SEQ ID NO: 5955 - protein, 43 aa, Artificial Sequence
  source: /note="Description of Artificial Sequence: Synthetic Destabilizing Domain Template"
MSHHWGYGKHNGPEHWHKDFPIAKGERQSPVDIDTHTAKYDPS

SEQ ID NO: 5956 - protein, 42 aa, Artificial Sequence
  source: /note="Description of Artificial Sequence: Synthetic Destabilizing Domain Template"
SHHWGYGKHNGPEHWHKDFPIAKGERQSPVDIDTHTAKYDPS

SEQ ID NO: 5957 - DNA, 423 bp, Artificial Sequence
  source: /note="Description of Artificial Sequence: Synthetic Destabilizing Domain (DD)"
tcccatcactgggggtacggcaaacacaacgaacctgagcactggcataaggacttccccattgccaagggagagcgccagtcccctgttgacatcgacactcatacagtcaagtatgacccttccctgaagcccctgtctgtttcctatgatcaagcaacttccctgaggatcctcaacaatggtcatgttttcaacgtggagtttgatgactctcaggacaaagcagtgctcaagggaggacccctggatggcacttacagattgattcagtttcactttcactgggttcacttgatggacaaggttcagagcatactgtggataaaaagaaatatgctgcagaatttcacttggttcactggaacaccaaatatggggattttgggagagctgtgcagcaacctgatggactggccgttc

SEQ ID NO: 5958 - DNA, 567 bp, Artificial Sequence
  source: /note="Description of Artificial Sequence: Synthetic Destabilizing Domain (DD)"
tcccatcactgggggtacggcaaacacaacggacctgagcactggcataaggacctccccattgccaagggagagcgccagtcccctgttgacatcgacactcatacagccaagtatgacccttccctgaatcccctgtctgtttcctatgatcaagcaacttccctgaggatcctcaacaatggtcatgctttcaacgtggagtttgatgactctcaggacaaagcagtgctcaagggaggacccctggatggcacttacagattgattcagtttcactttcactggggttcacttgatggacaacgttcagagcatactgtggataaaaagaaatatgctgtagaacttcacttggttcactggaacaccaaatatggggattttgggaaagctgtgcagcaacctgatggactggccgttctaggtatttttttgaaggttggcagcgctaaaccgggccttcagaaagttgttgatgtgctggattccattaaaacaaagggcaagagtggtgacttcactaacttcgatcctcgtggcctccttcctgaatccctggattac

SEQ ID NO: 5959 - DNA, 567 bp, Artificial Sequence
  source: /note="Description of Artificial Sequence: Synthetic Destabilizing Domain (DD)"
tcccatcactgggggtacggcaaacacaacggacctgagcattgggataaggacttccccattgccaagggagagcgccagtcctctgttgacatcgacactcatacagccaagtatgacccttccctgaagcccctgtctgtttcctatgatcaagcaacttccctgaggatcctcaacaatggtcatgctttcaacgtggagtttgatgactctcaggacaaagcagtgctcaaggtaggacccctggatggcacttacagattgattcagtttcactttcactggggttcacttgatggacaaggttcagagcatactgtggataaaaagaaatatgctgcagaacttcacttggttcactggaacaccaaatatggggattttgggagagctgtgcagcaacctgatggactggccgttctaggtatttttttgaaggttggcatcgataaaccgggccttcagaaagttgttgatgtgctggattccattaaaacaaagggcaagagtggtgacttcactaacttcgatcctcgtggcctccttcctgaatccctggattac

SEQ ID NO: 5960 - DNA, 264 bp, Artificial Sequence
  source: /note="Description of Artificial Sequence: Synthetic Destabilizing Domain (DD)"
tcccatcactgggggtacggcaaacacaacggacctgagcactggcataaggacttccccattgccaagggagagcgccagtcccctgttgacatcgacactcatacagccaagtatgacccatccctgaagcccctgtctgtttcctacgatcaagcaacttccctgaggaacctcaacaatggtcatgctttcaacgtggagtttgatgactctcaggacaaagcagtgctcaagggaggacccctggatggcacttacaga

SEQ ID NO: 5961 - DNA, 726 bp, Artificial Sequence
  source: /note="Description of Artificial Sequence: Synthetic Destabilizing Domain (DD)"
tcccatcactgggggtacggcaaacacaacggacctgagcactggcataaggacttccccattgccaagggagagcgccagtcccctgttgacatcgacattcatacagccaagtatgacccttccctgaagcccctgtctgtttcctatgatcaagcaacttccctgaggatcctcaacaatggtcatgctttcaacgtggagtttgatgactctcaggataaagcagtgctcaagggaggacccctggatggcacttacagattgattcagtttcactttcactggggttcacttgatggacaaggttcagagcatactgtggataaaaagaaacatgctgcagaacttcacttggttcactggaacaccaaatatggggattttgggaaagctgtgcagcaacctgatggactggccgttctaggtatttttttgaaggttggcagcgctaaactgggccttcagaaagttgttgttgtgctggattccattaaaacaaagggcaagagtgctgacttcactaacttcgatcctcgtggcctccttcctgaatccctggattactggacctacccaggctcactgaccaccgctcctcttctggaatgtgtgacctggattgtgctcaaggaacccatcagcgtcagcagcgagcgggtgttgaaattacgtaaacttaacttcaatggggacggtgaacccgaagaactgatggtggacaac

SEQ ID NO: 5962 - DNA, 564 bp, Artificial Sequence
  source: /note="Description of Artificial Sequence: Synthetic Destabilizing Domain (DD)"
tcccatcactgggggtacggcaaacacaacggacctgagcactggcataaggacttccccattgccaagggagagcgccagtcccctgttgacatcgacactcatacagccaagtatgacccttccctgaagcccctgtctgtttcctatgatcaagcaacttccctgaggatcctcaacaatggtcatgctttcaacgtggagtttgatgactctcaggacaaagcagtgctcaagggaggacccctagatggcacttacagattgattcagtttcactttcactggggttcacttgatggacaaggtttagagcatactgtggataaaaagaaatatgctgcagaacttcacttggttcactggaacaccaaatatggggattttgggaaagctgtgcagcaacctgatggagtggccgttctaggtatttttttgaaggttggcagcgctaaaccgtgccttcagaaagttgttgatgtgctggattccattaaaacaaagggcaagagtgctgacttcactaacttcgatcctcgtggcctccttcctgaatccctggat

SEQ ID NO: 5963 - DNA, 726 bp, Artificial Sequence
  source: /note="Description of Artificial Sequence: Synthetic Destabilizing Domain (DD)"
tcccatcactgggggtacggcaaacacaacggacctgagcactggcataaggacttccccattgccaagggagagcgccagtcccctgttgacatcgacattcatacagccaagtatgacccttccctgaagcccctgtctgtttcctatgatcaagcaacttccctgaggatcctcaacaatggtcatgctttcaacgtggagtttgatgactctcaggataaagcagtgctcaagggaggacccctggatggcacttacagattgattcagtttcactttcactggggttcacttgatggacaaggttcagagcatactgtggataaaaagaaacatgctgcagaacttcacttggttcactggaacaccaaatatggggattttgggaaagctgtgcagcaacctgatggactggccgttctaggtatttttttgaaggttggcagcgctaaactgggccttcagaaagttgttgttgtgctggattccattaaaacaaagggcaagagtgctgacttcactaacttcgatcctcgtggcctccttcctgaatccctggattactggacctacccaggctcactgaccaccgctcctcttctggaatgtgtgacctggattgtgctcaaggaacccatcagcgtcagcagcgagcaggtgttgaaattacgtaaacttaacttcaatggggacggtgaacccgaagaactgatggtggacaac

SEQ ID NO: 5964 - DNA, 345 bp, Artificial Sequence
  source: /note="Description of Artificial Sequence: Synthetic Destabilizing Domain (DD)"
tcccatcactgggggtacggcaaacacaacggacatgagcactggcataaggacttccccattgccaagggagagcgccagtcccctgttgacatcgacactcatacagccaagtatgacccttccctgaagcccctgtctgtttcctatgatcaagcaacttccctgaggatcctcaacaatggtcatgctttcaacgtggagtttgatgactctcaggacaaagcagtgctcaagggaggacccctggatggcacttacagattgattcagtttcactttcactggggttcacttgatggacaaggttcagagcatactgtggataaaaagaaatatgctgca

SEQ ID NO: 5965 - DNA, 453 bp, Artificial Sequence
  source: /note="Description of Artificial Sequence: Synthetic Destabilizing Domain (DD)"
tcccatcactgggggtacggcaaacacaacggacctgagcactggcataaggacttccccattgccaagggagagcgccagtcccctgttgacatcgacactcatacagccaagtatgacccttccctgaagcccctgtctgtttcctatgatcaagcaacttccctgaggatcctcaacaatggtcatgctttcaacgtggagtttgatgactctcaggacaaagcagtgctcaagggaggacccctggatggcacttacagattgattcagtttcactttcactggggttcacttgatggacaaggttcagagcatactgtggataaaaagaaatatgctgcagaacttcacttggttcactggaacaccaaatatggggattttgggaaaactgtgcagcaacctgatggactggccgttctaggtattttttttgaaggttggcagcgc

SEQ ID NO: 5966 - DNA, 453 bp, Artificial Sequence
  source: /note="Description of Artificial Sequence: Synthetic Destabilizing Domain (DD)"
tcccatcactgggggtacggcaaacacaacggacctgagcactggcataaggacctccccattgccaagggagagcgccagtcccctgttgacatcgacactcatacagccaagtatgacccttccctgaatcccctgtctgtttcctatgatcaagcaacttccctgaggatcctcaacaatggtcatgctttcaacgtggagtttgatgactctcaggacaaagcagtgctcaagggaggacccctggatggcacttacagattgattcagtttcactttcactggggttcacttgatggacaacgttcagagcatactgtggataaaaagaaatatgctgtagaacttcacttggttcactggaacaccaaatatggggattttgggaaagctgtgcagcaacctgatggactggccgttctaggtattttttttgaaggttggcagcgc

SEQ ID NO: 5967 - DNA, 126 bp, Artificial Sequence
  source: /note="Description of Artificial Sequence: Synthetic Destabilizing Domain (DD)"
tcccatcactgggggtacggcaaacacaaggacctgaacactggcataaggacttccccattgccaagggagagcgccagtcccctgttgacatcgacactcatacagccaagtatgacccttccc

SEQ ID NO: 5968 - protein, 30 aa, Artificial Sequence
  source: /note="Description of Artificial Sequence: Synthetic Linker"
GSGSGSGSGSGSGSGSGSGSGSGSGSGSGS

SEQ ID NO: 5969 - DNA, 90 bp, Artificial Sequence
  source: /note="Description of Artificial Sequence: Synthetic Linker"
ggatctggttctggttccggaagtggatctggttcagggtccggtagtggatctgggtcaggaagtggaagcggtagtgggtctggatct

SEQ ID NO: 5970 - protein, 1407 aa, Artificial Sequence
  source: /note="Description of Artificial Sequence: Synthetic construct"
MALPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSATNFSLLKQAGDVEENPGPMCHQQLVISWFSLVFLASPLVAIWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSGGGGSRNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNASGSGSGSGSGSGSGSGSGSGSGSGSGSGSGSTTTPAPRPPTPAPTIASQPLSLRPEACRPAAGGAVHTRGLDFACDIYIWAPLAGTCGVLLLSLVITLYCGSSHHWGYGKHNGPEHWHKDFPIAKGERQSPVDIDTHTAKYDPSLKPLSVSYDQATSLRNLNNGHAFNVEFDDSQDKAVLKGGPLDGTYRLIQFHFHWGSLDRQGSEHTVDKKKYAAELHLVHWNTKYGDFGKAVQQPDGLAVLGIFLKVGSAKPGLQKVVDVLDSIKTKGKSADFTNFDPRGLLPESLDYWTYPGSLTTPPLLECVTWIVLKEPISVSSEQVLKFRKLNFNGEGEPEELMVDNWRPAQPLKNRQIKASFK

SEQ ID NO: 5971 - DNA, 4224 bp, Artificial Sequence
  source: /note="Description of Artificial Sequence: Synthetic construct"
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggatcagctactaacttcagcctgctgaagcaggctggagacgtggaggagaaccctggacctatgtgccaccaacagctcgtgatcagctggttctccctggtgttcctggctagccccctggtggccatctgggagctcaagaaagacgtgtacgtggtggaactggactggtaccccgacgcccctggcgaaatggtggtgctgacatgcgacacccctgaggaggatggcattacctggaccctcgatcagagctccgaggtgctgggcagcggcaaaaccctgaccatccaggtgaaggagtttggcgatgccggccagtacacatgtcacaagggcggcgaggtgctgagccactccctgctgctgctccacaagaaggaagatggcatctggagcaccgacattctgaaggatcagaaggagcccaagaacaagacattcctgaggtgtgaggccaagaactacagcggcaggtttacctgctggtggctgacaacaatcagcaccgacctcacattctccgtcaagtcctccaggggttcttccgaccctcaaggcgtgacatgcggcgctgccaccctgagcgctgagagagtcaggggcgacaacaaggagtacgagtacagcgtcgaatgtcaggaggacagcgcctgtcccgccgctgaagagagcctgcctatcgaggtgatggtggacgccgtgcacaaactgaagtatgagaattacacctccagcttcttcatcagggacatcatcaaacccgatccccccaagaacctgcagctgaagcctctgaagaacagcagacaggtcgaagtgtcctgggagtaccctgatacctggtccacaccccacagctacttcagcctgaccttttgcgtgcaggtgcagggcaagagcaaaagggagaagaaggacagggtgtttaccgacaagacctccgccacagtgatttgcagaaagaacgcctccatcagcgtgagggcccaggacaggtattacagcagctcctggagcgaatgggctagcgtgccctgtagcggaggaggaggcagcggaggaggaggttctggaggaggcggcagcagaaacctgcctgtcgctacccccgaccccggaatgttcccctgcctgcaccactcccagaacctcctgagggccgtgtccaacatgctgcagaaggctagacagaccctcgaattctacccctgtaccagcgaggagatcgaccatgaggacatcaccaaggataagaccagcaccgtggaggcttgcctgcctctggagctgaccaaaaacgagagctgcctgaacagcagggaaaccagcttcattaccaacggctcctgcctggcctccaggaagacatccttcatgatggccctgtgcctcagcagcatctacgaggacctgaagatgtatcaggtggagtttaagaccatgaatgccaagctgctgatggaccctaagaggcagatcttcctggaccagaatatgctggccgtgattgacgagctgatgcaggccctcaactttaacagcgagaccgtgccccagaaaagcagcctcgaagagcctgacttctacaaaaccaagattaagctgtgtatcctgctgcacgccttcaggatcagggccgtgaccatcgacagggtgatgagctacctgaacgccagcggatctggttctggttccggaagtggatctggttcagggtccggtagtggatctgggtcaggaagtggaagcggtagtgggtctggatctaccacaaccccagcacctcgcccaccaacaccagcaccaaccatcgcatcccagccactgtctctgaggcccgaggcatgtaggcctgcagcaggaggcgccgtgcacaccaggggcctggactttgcctgcgatatctatatctgggcaccactggcaggaacatgtggcgtgctgctgctgtccctggtcatcaccctgtattgcggatcctcccatcactgggggtacggcaaacacaacggacctgagcactggcataaggacttccccattgccaagggagagcgccagtcccctgttgacatcgacactcatacagccaagtatgacccttccctgaagcccctgtctgtttcctatgatcaagcaacttccctgagaaacctcaacaatggtcatgctttcaacgtggagtttgatgactctcaggacaaagcagtgctcaagggaggacccctggatggcacttacagattgattcagtttcactttcactggggttcacttgatcgacaaggttcagagcatactgtggataaaaagaaatatgctgcagaacttcacttggttcactggaacaccaaatatggggattttgggaaagctgtgcagcaacctgatggactggccgttctaggtatttttttgaaggttggcagcgctaaaccgggccttcagaaagttgttgatgtgctggattccattaaaacaaagggcaagagtgctgacttcactaacttcgatcctcgtggcctccttcctgaatccctggattactggacctacccaggctcactgaccacccctcctcttctggaatgtgtgacctggattgtgctcaaggaacccatcagcgtcagcagcgagcaggtgttgaaattccgtaaacttaacttcaatggggagggtgaacccgaagaactgatggtggacaactggcgcccagctcagccactgaagaacaggcaaatcaaagcttccttcaaatga

SEQ ID NO: 5972 - protein, 1407 aa, Artificial Sequence
  source: /note="Description of Artificial Sequence: Synthetic construct"
MALPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSATNFSLLKQAGDVEENPGPMCHQQLVISWFSLVFLASPLVAIWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSGGGGSRNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNASGSGSGSGSGSGSGSGSGSGSGSGSGSGSGSTTTPAPRPPTPAPTIASQPLSLRPEACRPAAGGAVHTRGLDFACDIYIWAPLAGTCGVLLLSLVITLYCGSSHHWGYGKHNGPEHWHKDFPIAKGERQSPVDIDTHTAKYDPSLKPLSVSYDQATSLRILNNGHAFNVEFDDSQDKAVLKGGPLDGTYRLIQFHFHWGSLDGQGSEHTVDKKKYAAELHLVHWNTKYGDFGKAVQQPDGLAVLGIFLKVGSAKPGHQKVVDVLDSIKTKGKSADFTNFDPRGLLPESLDYWTYPGSLTTPPLLECVTWIVLKEPISVSSEQVLKFRKLNFNGEGEPEELMVDNWRPAQPLKNRQIKASFK

SEQ ID NO: 5973 - DNA, 4224 bp, Artificial Sequence
  source: /note="Description of Artificial Sequence: Synthetic construct"
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggatcagctactaacttcagcctgctgaagcaggctggagacgtggaggagaaccctggacctatgtgccaccaacagctcgtgatcagctggttctccctggtgttcctggctagccccctggtggccatctgggagctcaagaaagacgtgtacgtggtggaactggactggtaccccgacgcccctggcgaaatggtggtgctgacatgcgacacccctgaggaggatggcattacctggaccctcgatcagagctccgaggtgctgggcagcggcaaaaccctgaccatccaggtgaaggagtttggcgatgccggccagtacacatgtcacaagggcggcgaggtgctgagccactccctgctgctgctccacaagaaggaagatggcatctggagcaccgacattctgaaggatcagaaggagcccaagaacaagacattcctgaggtgtgaggccaagaactacagcggcaggtttacctgctggtggctgacaacaatcagcaccgacctcacattctccgtcaagtcctccaggggttcttccgaccctcaaggcgtgacatgcggcgctgccaccctgagcgctgagagagtcaggggcgacaacaaggagtacgagtacagcgtcgaatgtcaggaggacagcgcctgtcccgccgctgaagagagcctgcctatcgaggtgatggtggacgccgtgcacaaactgaagtatgagaattacacctccagcttcttcatcagggacatcatcaaacccgatccccccaagaacctgcagctgaagcctctgaagaacagcagacaggtcgaagtgtcctgggagtaccctgatacctggtccacaccccacagctacttcagcctgaccttttgcgtgcaggtgcagggcaagagcaaaagggagaagaaggacagggtgtttaccgacaagacctccgccacagtgatttgcagaaagaacgcctccatcagcgtgagggcccaggacaggtattacagcagctcctggagcgaatgggctagcgtgccctgtagcggaggaggaggcagcggaggaggaggttctggaggaggcggcagcagaaacctgcctgtcgctacccccgaccccggaatgttcccctgcctgcaccactcccagaacctcctgagggccgtgtccaacatgctgcagaaggctagacagaccctcgaattctacccctgtaccagcgaggagatcgaccatgaggacatcaccaaggataagaccagcaccgtggaggcttgcctgcctctggagctgaccaaaaacgagagctgcctgaacagcagggaaaccagcttcattaccaacggctcctgcctggcctccaggaagacatccttcatgatggccctgtgcctcagcagcatctacgaggacctgaagatgtatcaggtggagtttaagaccatgaatgccaagctgctgatggaccctaagaggcagatcttcctggaccagaatatgctggccgtgattgacgagctgatgcaggccctcaactttaacagcgagaccgtgccccagaaaagcagcctcgaagagcctgacttctacaaaaccaagattaagctgtgtatcctgctgcacgccttcaggatcagggccgtgaccatcgacagggtgatgagctacctgaacgccagcggatctggttctggttccggaagtggatctggttcagggtccggtagtggatctgggtcaggaagtggaagcggtagtgggtctggatctaccacaaccccagcacctcgcccaccaacaccagcaccaaccatcgcatcccagccactgtctctgaggcccgaggcatgtaggcctgcagcaggaggcgccgtgcacaccaggggcctggactttgcctgcgatatctatatctgggcaccactggcaggaacatgtggcgtgctgctgctgtccctggtcatcaccctgtattgcggatcctcccatcactgggggtacggcaaacacaacggacctgagcactggcataaggacttccccattgccaagggagagcgccagtcccctgttgacatcgacactcatacagccaagtatgacccttccctgaagcccctgtctgtttcctatgatcaagcaacttccctgagaatcctcaacaatggtcatgctttcaacgtggagtttgatgactctcaggacaaagcagtgctcaagggaggacccctggatggcacttacagattgattcagtttcactttcactggggttcacttgatggacaaggttcagagcatactgtggataaaaagaaatatgctgcagaacttcacttggttcactggaacaccaaatatggggattttgggaaagctgtgcagcaacctgatggactggccgttctaggtatttttttgaaggttggcagcgctaaaccgggccatcagaaagttgttgatgtgctggattccattaaaacaaagggcaagagtgctgacttcactaacttcgatcctcgtggcctccttcctgaatccctggattactggacctacccaggctcactgaccacccctcctcttctggaatgtgtgacctggattgtgctcaaggaacccatcagcgtcagcagcgagcaggtgttgaaattccgtaaacttaacttcaatggggagggtgaacccgaagaactgatggtggacaactggcgcccagctcagccactgaagaacaggcaaatcaaagcttccttcaaatga

SEQ ID NO: 5974 - protein, 1407 aa, Artificial Sequence; identical to SEQ ID NO: 5972
  source: /note="Description of Artificial Sequence: Synthetic construct"

SEQ ID NO: 5975 - DNA, 4224 bp, Artificial Sequence; identical to SEQ ID NO: 5973
  source: /note="Description of Artificial Sequence: Synthetic construct"

SEQ ID NO: 5976 - protein, 1407 aa, Artificial Sequence
  source: /note="Description of Artificial Sequence: Synthetic construct"
MALPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSATNFSLLKQAGDVEENPGPMCHQQLVISWFSLVFLASPLVAIWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSGGGGSRNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNASGSGSGSGSGSGSGSGSGSGSGSGSGSGSGSTTTPAPRPPTPAPTIASQPLSLRPEACRPAAGGAVHTRGLDFACDIYIWAPLAGTCGVLLLSLVITLYCGSSHHWGYGKHNGPEHWHKDFPIAKGERQSPVDIDTHTAKYDPSLKPLSVSYDQATSLRILNNDHAFNVVFDDSQDKAVLKGGPLDGTYRLIQFHFHWGSLDGQGSEHTVDKKKYAAELHLVHWNTKYGDFGKAVQQPDGLAVLGIFLKVGSAKPGLQKVVDVLDSIKTKGKSADFTNFDPRGLLPESLDYWTYPGSLTTPPLLECVTWIVLKEPISVSSEQVLKFRKLNFIGEGEPEELMVDNWRPAQPLKNRQIKASFK

SEQ ID NO: 5977 - DNA, 4224 bp, Artificial Sequence
  source: /note="Description of Artificial Sequence: Synthetic construct"
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggatcagctactaacttcagcctgctgaagcaggctggagacgtggaggagaaccctggacctatgtgccaccaacagctcgtgatcagctggttctccctggtgttcctggctagccccctggtggccatctgggagctcaagaaagacgtgtacgtggtggaactggactggtaccccgacgcccctggcgaaatggtggtgctgacatgcgacacccctgaggaggatggcattacctggaccctcgatcagagctccgaggtgctgggcagcggcaaaaccctgaccatccaggtgaaggagtttggcgatgccggccagtacacatgtcacaagggcggcgaggtgctgagccactccctgctgctgctccacaagaaggaagatggcatctggagcaccgacattctgaaggatcagaaggagcccaagaacaagacattcctgaggtgtgaggccaagaactacagcggcaggtttacctgctggtggctgacaacaatcagcaccgacctcacattctccgtcaagtcctccaggggttcttccgaccctcaaggcgtgacatgcggcgctgccaccctgagcgctgagagagtcaggggcgacaacaaggagtacgagtacagcgtcgaatgtcaggaggacagcgcctgtcccgccgctgaagagagcctgcctatcgaggtgatggtggacgccgtgcacaaactgaagtatgagaattacacctccagcttcttcatcagggacatcatcaaacccgatccccccaagaacctgcagctgaagcctctgaagaacagcagacaggtcgaagtgtcctgggagtaccctgatacctggtccacaccccacagctacttcagcctgaccttttgcgtgcaggtgcagggcaagagcaaaagggagaagaaggacagggtgtttaccgacaagacctccgccacagtgatttgcagaaagaacgcctccatcagcgtgagggcccaggacaggtattacagcagctcctggagcgaatgggctagcgtgccctgtagcggaggaggaggcagcggaggaggaggttctggaggaggcggcagcagaaacctgcctgtcgctacccccgaccccggaatgttcccctgcctgcaccactcccagaacctcctgagggccgtgtccaacatgctgcagaaggctagacagaccctcgaattctacccctgtaccagcgaggagatcgaccatgaggacatcaccaaggataagaccagcaccgtggaggcttgcctgcctctggagctgaccaaaaacgagagctgcctgaacagcagggaaaccagcttcattaccaacggctcctgcctggcctccaggaagacatccttcatgatggccctgtgcctcagcagcatctacgaggacctgaagatgtatcaggtggagtttaagaccatgaatgccaagctgctgatggaccctaagaggcagatcttcctggaccagaatatgctggccgtgattgacgagctgatgcaggccctcaactttaacagcgagaccgtgccccagaaaagcagcctcgaagagcctgacttctacaaaaccaagattaagctgtgtatcctgctgcacgccttcaggatcagggccgtgaccatcgacagggtgatgagctacctgaacgccagcggatctggttctggttccggaagtggatctggttcagggtccggtagtggatctgggtcaggaagtggaagcggtagtgggtctggatctaccacaaccccagcacctcgcccaccaacaccagcaccaaccatcgcatcccagccactgtctctgaggcccgaggcatgtaggcctgcagcaggaggcgccgtgcacaccaggggcctggactttgcctgcgatatctatatctgggcaccactggcaggaacatgtggcgtgctgctgctgtccctggtcatcaccctgtattgcggatcctcccatcactgggggtacggcaaacacaacggacctgagcactggcataaggacttccccattgccaagggagagcgccagtcccctgttgacatcgacactcatacagccaagtatgacccttccctgaagcccctgtctgtttcctatgatcaagcaacttccctgaggatcctcaacaatgatcatgctttcaacgtggtgtttgatgactctcaggacaaagcagtgctcaagggaggacccctggatggcacttacagattgattcagtttcactttcactggggttcacttgatggacaaggttcagagcatactgtggataaaaagaaatatgctgcagaacttcacttggttcactggaacaccaaatatggggattttgggaaagctgtacagcaacctgatggactggccgttctaggtatttttttgaaggttggcagcgctaaaccgggccttcagaaagttgttgatgtgctggattccattaaaacaaagggcaagagtgctgacttcactaacttcgatcctcgtggcctccttcctgaatccctggattactggacctacccaggctcactgaccacccctcctcttctggaatgtgtgacctggattgtgctcaaggaacccatcagcgtcagcagcgagcaggtgttgaaattccgtaaacttaacttcattggggagggtgaacccgaagaactgatggtggacaactggcgcccagctcagccactgaagaacaggcaaatcaaagcttccttcaaatga

SEQ ID NO: 5978 - protein, 1407 aa, Artificial Sequence
  source: /note="Description of Artificial Sequence: Synthetic construct"
MALPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSATNFSLLKQAGDVEENPGPMCHQQLVISWFSLVFLASPLVAIWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSGGGGSRNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNASGSGSGSGSGSGSGSGSGSGSGSGSGSGSGSTTTPAPRPPTPAPTIASQPLSLRPEACRPAAGGAVHTRGLDFACDIYIWAPLAGTCGVLLLSLVITLYCGSSHHWGYGKHNGPEHWHKDFPIAKGELQSPVDIDTHTAKYDPSLKPLSVSYDQATSLRILNNGHAFNVEFDDSQDKAVLKGGPLDGIYRLIQFHFHWGSLDGQGSEHTVDKKKYAAELHLVYWNTKYGDFGKAVQQPDGLAVLGIFLKVGSAKPGLQKVVDVLDSIKTKGKSADFTNFDPRGLLPESLDYWTYPGSLTTPPLLECVTWIVLKEPISVSSEQVLKFRKLNFNGEGEPEELMVDNWRPAQPLKDRQIKASFK

SEQ ID NO: 5979 - DNA, 4224 bp, Artificial Sequence
  source: /note="Description of Artificial Sequence: Synthetic construct"
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggatcagctactaacttcagcctgctgaagcaggctggagacgtggaggagaaccctggacctatgtgccaccaacagctcgtgatcagctggttctccctggtgttcctggctagccccctggtggccatctgggagctcaagaaagacgtgtacgtggtggaactggactggtaccccgacgcccctggcgaaatggtggtgctgacatgcgacacccctgaggaggatggcattacctggaccctcgatcagagctccgaggtgctgggcagcggcaaaaccctgaccatccaggtgaaggagtttggcgatgccggccagtacacatgtcacaagggcggcgaggtgctgagccactccctgctgctgctccacaagaaggaagatggcatctggagcaccgacattctgaaggatcagaaggagcccaagaacaagacattcctgaggtgtgaggccaagaactacagcggcaggtttacctgctggtggctgacaacaatcagcaccgacctcacattctccgtcaagtcctccaggggttcttccgaccctcaaggcgtgacatgcggcgctgccaccctgagcgctgagagagtcaggggcgacaacaaggagtacgagtacagcgtcgaatgtcaggaggacagcgcctgtcccgccgctgaagagagcctgcctatcgaggtgatggtggacgccgtgcacaaactgaagtatgagaattacacctccagcttcttcatcagggacatcatcaaacccgatccccccaagaacctgcagctgaagcctctgaagaacagcagacaggtcgaagtgtcctgggagtaccctgatacctggtccacaccccacagctacttcagcctgaccttttgcgtgcaggtgcagggcaagagcaaaagggagaagaaggacagggtgtttaccgacaagacctccgccacagtgatttgcagaaagaacgcctccatcagcgtgagggcccaggacaggtattacagcagctcctggagcgaatgggctagcgtgccctgtagcggaggaggaggcagcggaggaggaggttctggaggaggcggcagcagaaacctgcctgtcgctacccccgaccccggaatgttcccctgcctgcaccactcccagaacctcctgagggccgtgtccaacatgctgcagaaggctagacagaccctcgaattctacccctgtaccagcgaggagatcgaccatgaggacatcaccaaggataagaccagcaccgtggaggcttgcctgcctctggagctgaccaaaaacgagagctgcctgaacagcagggaaaccagcttcattaccaacggctcctgcctggcctccaggaagacatccttcatgatggccctgtgcctcagcagcatctacgaggacctgaagatgtatcaggtggagtttaagaccatgaatgccaagctgctgatggaccctaagaggcagatcttcctggaccagaatatgctggccgtgattgacgagctgatgcaggccctcaactttaacagcgagaccgtgccccagaaaagcagcctcgaagagcctgacttctacaaaaccaagattaagctgtgtatcctgctgcacgccttcaggatcagggccgtgaccatcgacagggtgatgagctacctgaacgccagcggatctggttctggttccggaagtggatctggttcagggtccggtagtggatctgggtcaggaagtggaagcggtagtgggtctggatctaccacaaccccagcacctcgcccaccaacaccagcaccaaccatcgcatcccagccactgtctctgaggcccgaggcatgtaggcctgcagcaggaggcgccgtgcacaccaggggcctggactttgcctgcgatatctatatctgggcaccactggcaggaacatgtggcgtgctgctgctgtccctggtcatcaccctgtattgcggatcctcccatcactgggggtacggcaaacacaacggacctgagcactggcataaggacttccccattgccaagggagagctccagtcccctgttgacatcgacactcatacagccaagtatgacccttccctgaagcccctgtctgtttcctatgatcaagcaacttccctgaggatcctcaacaatggtcatgctttcaacgtggagtttgatgactctcaggacaaagcagtgctcaagggaggacccctggatggcatttacagattgattcagtttcactttcactggggttcacttgatggacaaggttcagagcatactgtggataaaaagaaatatgctgcagaacttcacttggtttactggaacaccaaatatggggattttgggaaagctgtgcagcaacctgatggactggccgttctaggtatttttttgaaggttggcagcgctaaaccgggccttcagaaagttgttgatgtgctggattccattaaaacaaagggcaagagtgctgacttcactaacttcgatcctcgtggcctccttcctgaatccctggattactggacctacccaggctcactgaccacccctcctcttctggaatgtgtgacctggattgtgctcaaggaacccatcagcgtcagcagcgagcaggtgttgaaattccgtaaacttaacttcaatggggagggtgaacccgaagaactgatggtggacaactggcgcccagctcagccactgaaggacaggcaaatcaaagcttccttcaaatga

SEQ ID NO: 5980 - protein, 486 aa, Artificial Sequence; identical to SEQ ID NO: 1757
  source: /note="Description of Artificial Sequence: Synthetic Construct"

SEQ ID NO: 5981 - DNA, 1461 bp, Artificial Sequence
  source: /note="Description of Artificial Sequence: Synthetic Construct"
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 5982 - protein, 8 aa, Artificial Sequence
  source: /note="Description of Artificial Sequence: Synthetic peptide"
KQEHFPDN

SEQ ID NO: 5983 - DNA, 24 bp, Artificial Sequence
  source: /note="Description of Artificial Sequence: Synthetic oligonucleotide"
aaacaagagcactttcctgataac

SEQ ID NO: 5984 - protein, 21 aa, Artificial Sequence
  source: /note="Description of Artificial Sequence: Synthetic peptide"
LLPSWAITLISVNGIFVICCL

SEQ ID NO: 5985 - DNA, 63 bp, Artificial Sequence
  source: /note="Description of Artificial Sequence: Synthetic oligonucleotide"
ctgttgccgagctgggcgattacgcttatcagtgtaaacggcatctttgtaatatgctgtctg

SEQ ID NO: 5986 - protein, 12 aa, Artificial Sequence
  source: /note="Description of Artificial Sequence: Synthetic peptide"
TYCFAPRCRERR

SEQ ID NO: 5987 - DNA, 36 bp, Artificial Sequence
  source: /note="Description of Artificial Sequence: Synthetic oligonucleotide"
acctactgcttcgcaccaaggtgccgggagagaagg

SEQ ID NO: 5988 - protein, 6 aa, Artificial Sequence
  source: /note="Description of Artificial Sequence: Synthetic peptide"
NHRNRR

SEQ ID NO: 5989 - DNA, 18 bp, Artificial Sequence
  source: /note="Description of Artificial Sequence: Synthetic oligonucleotide"
aaccatagaaacaggcga

SEQ ID NO: 5990 - protein, 103 aa, Artificial Sequence
  source: /note="Description of Artificial Sequence: Synthetic polypeptide"
ADFPTPSISDFEIPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 5991 - DNA, 309 bp, Artificial Sequence
  source: /note="Description of Artificial Sequence: Synthetic polynucleotide"
gccgacttcccaacgccaagtatttcagattttgagatacccactagcaatataagacgcatcatctgttcaacctctgggggtttccccgagccccatctgtcttggctggaaaacggggaagaacttaatgctataaacactactgtttctcaagatcccgaaactgaactctatgctgtatccagcaaactcgacttcaatatgactacgaaccattcctttatgtgtcttattaagtatggccacttgcgcgtcaaccaaacctttaattggaatactactaaacaagagcactttcctgataac

SEQ ID NO: 5992 - protein, 227 aa, Artificial Sequence
  source: /note="Description of Artificial Sequence: Synthetic polypeptide"
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5993 - DNA, 681 bp, Artificial Sequence
  source: /note="Description of Artificial Sequence: Synthetic polynucleotide"
gacaagacccatacttgccctccgtgccctgcgccggaactgctcggaggtcctagcgtctttcttttcccgccaaaacctaaggatacactcatgattagtcgaacccccgaagtgacgtgtgtagtcgtagacgttagccacgaagaccccgaagttaagttcaattggtacgtggatggcgtcgaggtacataacgctaaaaccaagcctcgagaggagcaatataactccacataccgagtggtctctgtgcttacggtgcttcaccaagattggctcaatggcaaagagtataagtgcaaggtgtctaataaggctctccctgctcccatagaaaagacgataagcaaagcaaagggacagccccgcgagccacaggtatacactctgccgccttctcgagatgagttgactaaaaaccaggtttccctcacctgtttggtcaaaggtttctatccgtctgacatcgctgtcgagtgggagagtaatggacagcctgagaacaactataagaccactccaccggtcttggacagcgatggatctttttttctgtactcaaaacttacagtagacaagtcacgatggcagcagggaaatgtcttttcctgctctgtaatgcacgaagcattgcataaccactatacgcagaaatccctttcattgtctccgggtaaa

SEQ ID NO: 5994 - protein, 37 aa, Artificial Sequence
  source: /note="Description of Artificial Sequence: Synthetic polypeptide"
FSIPQANHSHSGDYHCTGNIGYTLYSSKPVTITVQAP

SEQ ID NO: 5995 - DNA, 111 bp, Artificial Sequence
  source: /note="Description of Artificial Sequence: Synthetic polynucleotide"
ttttctatcccgcaagcgaatcacagccattctggtgattaccactgcacgggcaatatcggttacacactctactcctcaaagcccgtcacgataacggtgcaggcacca

SEQ ID NO: 5996 - protein, 25 aa, Artificial Sequence
  source: /note="Description of Artificial Sequence: Synthetic peptide"
TYCFAPRCRERRRNERLRRESVRPV

SEQ ID NO: 5997 - protein, 550 aa, Artificial Sequence
  source: /note="Description of Artificial Sequence: Synthetic polypeptide"
QKKPRYEIRWKVIESVSSDGHEYIYVDPMQLPYDSTWELPRDQLVLGRTLGSGAFGQVVEATAHGLSHSQATMKVAVKMLKSTARSSEKQALMSELKIMSHLGPHLNVVNLLGACTKGGPIYIITEYCRYGDLVDYLHRNKHTFLQHHSDKRRPPSAELYSNALPVGLPLPSHVSLTGESDGGYMDMSKDESVDYVPMLDMKGDVKYADIESSNYMAPYDNYVPSAPERTCRATLINESPVLSYMDLVGFSYQVANGMEFLASKNCVHRDLAARNVLICEGKLVKICDFGLARDIMRDSNYISKGSTFLPLKWMAPESIFNSLYTTLSDVWSFGILLWEIFTLGGTPYPELPMNEQFYNAIKRGYRMAQPAHASDEIYEIMQKCWEEKFEIRPPFSQLVLLLERLLGEGYKKKYQQVDEEFLRSDHPAILRSQARLPGFHGLRSPLDTSSVLYTAVQPNEGDNDYIIPLPDPKPEVADEGPLEGSPSLASSTLNEVNTSSTISCDSPLEPQDEPEPEPQLELQVEPEPELEQLPDSGCPAPRAEAEDSFL

SEQ ID NO: 5998 - protein, 22 aa, Artificial Sequence
  source: /note="Description of Artificial Sequence: Synthetic peptide"
QKKPRYEIRWKVIESVSSDGHE

SEQ ID NO: 5999 - protein, 183 aa, Artificial Sequence
  source: /note="Description of Artificial Sequence: Synthetic polypeptide"
QKKPRYEIRWKVIESVSSDGHEFIFVDPMQLPYDSTWELPRDQLVLGRTLGSGAFGQVVEATAHGLSHSQATMKVAVAMLKSTARSSEKQALMSELKIMSHLGPHLNVVNLLGACTKGGPIYIITEYCRYGDLVDYLHRNKHTFLQHHSDKRRPPSAELYSNALPVGLPLPSHVSLTGESDGG

SEQ ID NO: 6000 - protein, 23 aa, Artificial Sequence
  source: /note="Description of Artificial Sequence: Synthetic peptide"
IYIWAPLAGICVALLLSLIITLI

SEQ ID NO: 6001 - protein, 25 aa, Artificial Sequence
  source: /note="Description of Artificial Sequence: Synthetic peptide"
VVVISAILALVVLTVISLIILIMLW

SEQ ID NO: 6002 - protein, 22 aa, Artificial Sequence
  source: /note="Description of Artificial Sequence: Synthetic peptide"
TLVLFGAGFGAVITVVVIVVII

SEQ ID NO: 6003 - protein, 32 aa, Artificial Sequence
  source: /note="Description of Artificial Sequence: Synthetic polypeptide"
KCFCKHRSCFRRNEASRETNNSLTFGPEEALA

SEQ ID NO: 6004 - protein, 20 aa, Artificial Sequence
  source: /note="Description of Artificial Sequence: Synthetic Signal sequence"
ALPVTALLLPLALLLHAARP

SEQ ID NO: 6005 - DNA, 60 bp, Artificial Sequence
  source: /note="Description of Artificial Sequence: Synthetic Signal sequence"
gccttaccagtgaccgccttgctcctgccgctggccttgctgctccacgccgccaggccg

SEQ ID NO: 6006 - protein, 21 aa, Artificial Sequence
  source: /note="Description of Artificial Sequence: Synthetic Signal sequence"
CHQQLVISWFSLVFLASPLVA

SEQ ID NO: 6007 - DNA, 63 bp, Artificial Sequence
  source: /note="Description of Artificial Sequence: Synthetic Signal sequence"
tgccaccaacagctcgtgatcagctggttctccctggtgttcctggctagccccctggtggcc

SEQ ID NO: 6008 - DNA, 36 bp, Artificial Sequence
  source: /note="Description of Artificial Sequence: Synthetic Linker"
ggtggatccggaggtggaagtggaggtggatctggt

SEQ ID NO: 6009 - DNA, 36 bp, Artificial Sequence
  source: /note="Description of Artificial Sequence: Synthetic Linker"
ggaggttctggaggtggaagtggaggtggatccggt

SEQ ID NO: 6010 - DNA, 36 bp, Artificial Sequence
  source: /note="Description of Artificial Sequence: Synthetic Linker"
ggaggttctggtggtggtagtggaggaggatcaggt

SEQ ID NO: 6011-6020 - skipped (10 entries)

SEQ ID NO: 6021 - protein, 239 aa, Artificial Sequence
  source: /note="Description of Artificial Sequence: Synthetic Construct"
MVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSKLSKDPNEKRDHMVLLEFVTAAGITLGMDELYK

SEQ ID NO: 6022 - DNA, 717 bp, Artificial Sequence
  source: /note="Description of Artificial Sequence: Synthetic Construct"
atggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccaagctgagcaaagaccccaacgagaagcgcgatcacatggtcctgctggagttcgtgaccgccgccgggatcactctcggcatggacgagctgtacaag

SEQ ID NO: 6023-6056 - skipped (34 entries)

SEQ ID NO: 6057 - protein, 1148 aa, Artificial Sequence
  source: /note="Description of Artificial Sequence: Synthetic Construct"
MALPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSATNFSLLKQAGDVEENPGPMCHQQLVISWFSLVFLASPLVAIWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSGGGGSRNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNASGSGSGSGSGSGSGSGSGSGSGSGSGSGSGSTTTPAPRPPTPAPTIASQPLSLRPEACRPAAGGAVHTRGLDFACDIYIWAPLAGTCGVLLLSLVITLYCGS

SEQ ID NO: 6058 - DNA, 3447 bp, Artificial Sequence
  source: /note="Description of Artificial Sequence: Synthetic Construct"
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggatcagctactaacttcagcctgctgaagcaggctggagacgtggaggagaaccctggacctatgtgccaccaacagctcgtgatcagctggttctccctggtgttcctggctagccccctggtggccatctgggagctcaagaaagacgtgtacgtggtggaactggactggtaccccgacgcccctggcgaaatggtggtgctgacatgcgacacccctgaggaggatggcattacctggaccctcgatcagagctccgaggtgctgggcagcggcaaaaccctgaccatccaggtgaaggagtttggcgatgccggccagtacacatgtcacaagggcggcgaggtgctgagccactccctgctgctgctccacaagaaggaagatggcatctggagcaccgacattctgaaggatcagaaggagcccaagaacaagacattcctgaggtgtgaggccaagaactacagcggcaggtttacctgctggtggctgacaacaatcagcaccgacctcacattctccgtcaagtcctccaggggttcttccgaccctcaaggcgtgacatgcggcgctgccaccctgagcgctgagagagtcaggggcgacaacaaggagtacgagtacagcgtcgaatgtcaggaggacagcgcctgtcccgccgctgaagagagcctgcctatcgaggtgatggtggacgccgtgcacaaactgaagtatgagaattacacctccagcttcttcatcagggacatcatcaaacccgatccccccaagaacctgcagctgaagcctctgaagaacagcagacaggtcgaagtgtcctgggagtaccctgatacctggtccacaccccacagctacttcagcctgaccttttgcgtgcaggtgcagggcaagagcaaaagggagaagaaggacagggtgtttaccgacaagacctccgccacagtgatttgcagaaagaacgcctccatcagcgtgagggcccaggacaggtattacagcagctcctggagcgaatgggctagcgtgccctgtagcggaggaggaggcagcggaggaggaggttctggaggaggcggcagcagaaacctgcctgtcgctacccccgaccccggaatgttcccctgcctgcaccactcccagaacctcctgagggccgtgtccaacatgctgcagaaggctagacagaccctcgaattctacccctgtaccagcgaggagatcgaccatgaggacatcaccaaggataagaccagcaccgtggaggcttgcctgcctctggagctgaccaaaaacgagagctgcctgaacagcagggaaaccagcttcattaccaacggctcctgcctggcctccaggaagacatccttcatgatggccctgtgcctcagcagcatctacgaggacctgaagatgtatcaggtggagtttaagaccatgaatgccaagctgctgatggaccctaagaggcagatcttcctggaccagaatatgctggccgtgattgacgagctgatgcaggccctcaactttaacagcgagaccgtgccccagaaaagcagcctcgaagagcctgacttctacaaaaccaagattaagctgtgtatcctgctgcacgccttcaggatcagggccgtgaccatcgacagggtgatgagctacctgaacgccagcggatctggttctggttccggaagtggatctggttcagggtccggtagtggatctgggtcaggaagtggaagcggtagtgggtctggatctaccacaaccccagcacctcgcccaccaacaccagcaccaaccatcgcatcccagccactgtctctgaggcccgaggcatgtaggcctgcagcaggaggcgccgtgcacaccaggggcctggactttgcctgcgatatctatatctgggcaccactggcaggaacatgtggcgtgctgctgctgtccctggtcatcaccctgtattgcggatcctga

SEQ ID NO: 6059 - protein, 1407 aa, Artificial Sequence
  source: /note="Description of Artificial Sequence: Synthetic Construct"
MALPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSATNFSLLKQAGDVEENPGPMCHQQLVISWFSLVFLASPLVAIWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSGGGGSRNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNASGSGSGSGSGSGSGSGSGSGSGSGSGSGSGSTTTPAPRPPTPAPTIASQPLSLRPEACRPAAGGAVHTRGLDFACDIYIWAPLAGTCGVLLLSLVITLYCGSSHHWGYGKHNGPEHWHKDFPIAKGERQSPVDIDTHTAKYDPSLKPLSVSYDQATSLRILNNGHAFNVEFDDSQDKAVLKGGPLDGTYRLIQFHFHWGSLDGQGSEHTVDKKKYAAELHLVHWNTKYGDFGKAVQQPDGLAVLGIFLKVGSAKPGLQKVVDVLDSIKTKGKSADFTNFDPRGLLPESLDYWTYPGSLTTPPLLECVTWIVLKEPISVSSEQVLKFRKLNFNGEGEPEELMVDNWRPAQPLKNRQIKASFK

SEQ ID NO: 6060 - DNA, 4224 bp, Artificial Sequence
  source: /note="Description of Artificial Sequence: Synthetic Construct"
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggatcagctactaacttcagcctgctgaagcaggctggagacgtggaggagaaccctggacctatgtgccaccaacagctcgtgatcagctggttctccctggtgttcctggctagccccctggtggccatctgggagctcaagaaagacgtgtacgtggtggaactggactggtaccccgacgcccctggcgaaatggtggtgctgacatgcgacacccctgaggaggatggcattacctggaccctcgatcagagctccgaggtgctgggcagcggcaaaaccctgaccatccaggtgaaggagtttggcgatgccggccagtacacatgtcacaagggcggcgaggtgctgagccactccctgctgctgctccacaagaaggaagatggcatctggagcaccgacattctgaaggatcagaaggagcccaagaacaagacattcctgaggtgtgaggccaagaactacagcggcaggtttacctgctggtggctgacaacaatcagcaccgacctcacattctccgtcaagtcctccaggggttcttccgaccctcaaggcgtgacatgcggcgctgccaccctgagcgctgagagagtcaggggcgacaacaaggagtacgagtacagcgtcgaatgtcaggaggacagcgcctgtcccgccgctgaagagagcctgcctatcgaggtgatggtggacgccgtgcacaaactgaagtatgagaattacacctccagcttcttcatcagggacatcatcaaacccgatccccccaagaacctgcagctgaagcctctgaagaacagcagacaggtcgaagtgtcctgggagtaccctgatacctggtccacaccccacagctacttcagcctgaccttttgcgtgcaggtgcagggcaagagcaaaagggagaagaaggacagggtgtttaccgacaagacctccgccacagtgatttgcagaaagaacgcctccatcagcgtgagggcccaggacaggtattacagcagctcctggagcgaatgggctagcgtgccctgtagcggaggaggaggcagcggaggaggaggttctggaggaggcggcagcagaaacctgcctgtcgctacccccgaccccggaatgttcccctgcctgcaccactcccagaacctcctgagggccgtgtccaacatgctgcagaaggctagacagaccctcgaattctacccctgtaccagcgaggagatcgaccatgaggacatcaccaaggataagaccagcaccgtggaggcttgcctgcctctggagctgaccaaaaacgagagctgcctgaacagcagggaaaccagcttcattaccaacggctcctgcctggcctccaggaagacatccttcatgatggccctgtgcctcagcagcatctacgaggacctgaagatgtatcaggtggagtttaagaccatgaatgccaagctgctgatggaccctaagaggcagatcttcctggaccagaatatgctggccgtgattgacgagctgatgcaggccctcaactttaacagcgagaccgtgccccagaaaagcagcctcgaagagcctgacttctacaaaaccaagattaagctgtgtatcctgctgcacgccttcaggatcagggccgtgaccatcgacagggtgatgagctacctgaacgccagcggatctggttctggttccggaagtggatctggttcagggtccggtagtggatctgggtcaggaagtggaagcggtagtgggtctggatctaccacaaccccagcacctcgcccaccaacaccagcaccaaccatcgcatcccagccactgtctctgaggcccgaggcatgtaggcctgcagcaggaggcgccgtgcacaccaggggcctggactttgcctgcgatatctatatctgggcaccactggcaggaacatgtggcgtgctgctgctgtccctggtcatcaccctgtattgcggatcctcccatcactgggggtacggcaaacacaacggacctgagcactggcataaggacttccccattgccaagggagagcgccagtcccctgttgacatcgacactcatacagccaagtatgacccttccctgaagcccctgtctgtttcctatgatcaagcaacttccctgaggatcctcaacaatggtcatgctttcaacgtggagtttgatgactctcaggacaaagcagtgctcaagggaggacccctggatggcacttacagattgattcagtttcactttcactggggttcacttgatggacaaggttcagagcatactgtggataaaaagaaatatgctgcagaacttcacttggttcactggaacaccaaatatggggattttgggaaagctgtgcagcaacctgatggactggccgttctaggtatttttttgaaggttggcagcgctaaaccgggccttcagaaagttgttgatgtgctggattccattaaaacaaagggcaagagtgctgacttcactaacttcgatcctcgtggcctccttcctgaatccctggattactggacctacccaggctcactgaccacccctcctcttctggaatgtgtgacctggattgtgctcaaggaacccatcagcgtcagcagcgagcaggtgttgaaattccgtaaacttaacttcaatggggagggtgaacccgaagaactgatggtggacaactggcgcccagctcagccactgaagaacaggcaaatcaaagcttccttcaaatga

SEQ ID NO: 6061 - protein, 1452 aa, Artificial Sequence
  source: /note="Description of Artificial Sequence: Synthetic Construct"
MALPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSATNFSLLKQAGDVEENPGPMCHQQLVISWFSLVFLASPLVAIWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSGGGGSRNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNASGSGSGSGSADFPTPSISDFEIPTSNIRRIICSTSGGFPEPHLSWLENGEELNAINTTVSQDPETELYAVSSKLDFNMTTNHSFMCLIKYGHLRVNQTFNWNTTKQEHFPDNLLPSWAITLISVNGIFVICCLTYCFAPRCRERRGSSHHWGYGKHNGPEHWHKDFPIAKGERQSPVDIDTHTAKYDPSLKPLSVSYDQATSLRILNNGHAFNVEFDDSQDKAVLKGGPLDGTYRLIQFHFHWGSLDGQGSEHTVDKKKYAAELHLVHWNTKYGDFGKAVQQPDGLAVLGIFLKVGSAKPGHQKVVDVLDSIKTKGKSADFTNFDPRGLLPESLDYWTYPGSLTTPPLLECVTWIVLKEPISVSSEQVLKFRKLNFNGEGEPEELMVDNWRPAQPLKNRQIKASFK

SEQ ID NO: 6062 - DNA, 4359 bp, Artificial Sequence
  source: /note="Description of Artificial Sequence: Synthetic Construct"
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggatcagctactaacttcagcctgctgaagcaggctggagacgtggaggagaaccctggacctatgtgccaccaacagctcgtgatcagctggttctccctggtgttcctggctagccccctggtggccatctgggagctcaagaaagacgtgtacgtggtggaactggactggtaccccgacgcccctggcgaaatggtggtgctgacatgcgacacccctgaggaggatggcattacctggaccctcgatcagagctccgaggtgctgggcagcggcaaaaccctgaccatccaggtgaaggagtttggcgatgccggccagtacacatgtcacaagggcggcgaggtgctgagccactccctgctgctgctccacaagaaggaagatggcatctggagcaccgacattctgaaggatcagaaggagcccaagaacaagacattcctgaggtgtgaggccaagaactacagcggcaggtttacctgctggtggctgacaacaatcagcaccgacctcacattctccgtcaagtcctccaggggttcttccgaccctcaaggcgtgacatgcggcgctgccaccctgagcgctgagagagtcaggggcgacaacaaggagtacgagtacagcgtcgaatgtcaggaggacagcgcctgtcccgccgctgaagagagcctgcctatcgaggtgatggtggacgccgtgcacaaactgaagtatgagaattacacctccagcttcttcatcagggacatcatcaaacccgatccccccaagaacctgcagctgaagcctctgaagaacagcagacaggtcgaagtgtcctgggagtaccctgatacctggtccacaccccacagctacttcagcctgaccttttgcgtgcaggtgcagggcaagagcaaaagggagaagaaggacagggtgtttaccgacaagacctccgccacagtgatttgcagaaagaacgcctccatcagcgtgagggcccaggacaggtattacagcagctcctggagcgaatgggctagcgtgccctgtagcggaggaggaggcagcggaggaggaggttctggaggaggcggcagcagaaacctgcctgtcgctacccccgaccccggaatgttcccctgcctgcaccactcccagaacctcctgagggccgtgtccaacatgctgcagaaggctagacagaccctcgaattctacccctgtaccagcgaggagatcgaccatgaggacatcaccaaggataagaccagcaccgtggaggcttgcctgcctctggagctgaccaaaaacgagagctgcctgaacagcagggaaaccagcttcattaccaacggctcctgcctggcctccaggaagacatccttcatgatggccctgtgcctcagcagcatctacgaggacctgaagatgtatcaggtggagtttaagaccatgaatgccaagctgctgatggaccctaagaggcagatcttcctggaccagaatatgctggccgtgattgacgagctgatgcaggccctcaactttaacagcgagaccgtgccccagaaaagcagcctcgaagagcctgacttctacaaaaccaagattaagctgtgtatcctgctgcacgccttcaggatcagggccgtgaccatcgacagggtgatgagctacctgaacgccagcggatctggttctggttccggaagtgccgacttcccaacgccaagtatttcagattttgagatacccactagcaatataagacgcatcatctgttcaacctctgggggtttccccgagccccatctgtcttggctggaaaacggggaagaacttaatgctataaacactactgtttctcaagatcccgaaactgaactctatgctgtatccagcaaactcgacttcaatatgactacgaaccattcctttatgtgtcttattaagtatggccacttgcgcgtcaaccaaacctttaattggaatactactaaacaagagcactttcctgataacctgttgccgagctgggcgattacgcttatcagtgtaaacggcatctttgtaatatgctgtctgacctactgcttcgcaccaaggtgccgggagagaaggggatcctcccatcactgggggtacggcaaacacaacggacctgagcactggcataaggacttccccattgccaagggagagcgccagtcccctgttgacatcgacactcatacagccaagtatgacccttccctgaagcccctgtctgtttcctatgatcaagcaacttccctgagaatcctcaacaatggtcatgctttcaacgtggagtttgatgactctcaggacaaagcagtgctcaagggaggacccctggatggcacttacagattgattcagtttcactttcactggggttcacttgatggacaaggttcagagcatactgtggataaaaagaaatatgctgcagaacttcacttggttcactggaacaccaaatatggggattttgggaaagctgtgcagcaacctgatggactggccgttctaggtatttttttgaaggttggcagcgctaaaccgggccatcagaaagttgttgatgtgctggattccattaaaacaaagggcaagagtgctgacttcactaacttcgatcctcgtggcctccttcctgaatccctggattactggacctacccaggctcactgaccacccctcctcttctggaatgtgtgacctggattgtgctcaaggaacccatcagcgtcagcagcgagcaggtgttgaaattccgtaaacttaacttcaatggggagggtgaacccgaagaactgatggtggacaactggcgcccagctcagccactgaagaacaggcaaatcaaagcttccttcaaataa

SEQ ID NO: 6063 - protein, 1584 aa, Artificial Sequence
  source: /note="Description of Artificial Sequence: Synthetic Construct"
MALPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSATNFSLLKQAGDVEENPGPMCHQQLVISWFSLVFLASPLVAIWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSGGGGSRNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNASGSGSGSGSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKKQEHFPDNLLPSWAITLISVNGIFVICCLTYCFAPRCRERRGSSHHWGYGKHNGPEHWHKDFPIAKGERQSPVDIDTHTAKYDPSLKPLSVSYDQATSLRILNNGHAFNVEFDDSQDKAVLKGGPLDGTYRLIQFHFHWGSLDGQGSEHTVDKKKYAAELHLVHWNTKYGDFGKAVQQPDGLAVLGIFLKVGSAKPGHQKVVDVLDSIKTKGKSADFTNFDPRGLLPESLDYWTYPGSLTTPPLLECVTWIVLKEPISVSSEQVLKFRKLNFNGEGEPEELMVDNWRPAQPLKNRQIKASFK

SEQ ID NO: 6064 - DNA, 4755 bp, Artificial Sequence
  source: /note="Description of Artificial Sequence: Synthetic Construct"
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggatcagctactaacttcagcctgctgaagcaggctggagacgtggaggagaaccctggacctatgtgccaccaacagctcgtgatcagctggttctccctggtgttcctggctagccccctggtggccatctgggagctcaagaaagacgtgtacgtggtggaactggactggtaccccgacgcccctggcgaaatggtggtgctgacatgcgacacccctgaggaggatggcattacctggaccctcgatcagagctccgaggtgctgggcagcggcaaaaccctgaccatccaggtgaaggagtttggcgatgccggccagtacacatgtcacaagggcggcgaggtgctgagccactccctgctgctgctccacaagaaggaagatggcatctggagcaccgacattctgaaggatcagaaggagcccaagaacaagacattcctgaggtgtgaggccaagaactacagcggcaggtttacctgctggtggctgacaacaatcagcaccgacctcacattctccgtcaagtcctccaggggttcttccgaccctcaaggcgtgacatgcggcgctgccaccctgagcgctgagagagtcaggggcgacaacaaggagtacgagtacagcgtcgaatgtcaggaggacagcgcctgtcccgccgctgaagagagcctgcctatcgaggtgatggtggacgccgtgcacaaactgaagtatgagaattacacctccagcttcttcatcagggacatcatcaaacccgatccccccaagaacctgcagctgaagcctctgaagaacagcagacaggtcgaagtgtcctgggagtaccctgatacctggtccacaccccacagctacttcagcctgaccttttgcgtgcaggtgcagggcaagagcaaaagggagaagaaggacagggtgtttaccgacaagacctccgccacagtgatttgcagaaagaacgcctccatcagcgtgagggcccaggacaggtattacagcagctcctggagcgaatgggctagcgtgccctgtagcggaggaggaggcagcggaggaggaggttctggaggaggcggcagcagaaacctgcctgtcgctacccccgaccccggaatgttcccctgcctgcaccactcccagaacctcctgagggccgtgtccaacatgctgcagaaggctagacagaccctcgaattctacccctgtaccagcgaggagatcgaccatgaggacatcaccaaggataagaccagcaccgtggaggcttgcctgcctctggagctgaccaaaaacgagagctgcctgaacagcagggaaaccagcttcattaccaacggctcctgcctggcctccaggaagacatccttcatgatggccctgtgcctcagcagcatctacgaggacctgaagatgtatcaggtggagtttaagaccatgaatgccaagctgctgatggaccctaagaggcagatcttcctggaccagaatatgctggccgtgattgacgagctgatgcaggccctcaactttaacagcgagaccgtgccccagaaaagcagcctcgaagagcctgacttctacaaaaccaagattaagctgtgtatcctgctgcacgccttcaggatcagggccgtgaccatcgacagggtgatgagctacctgaacgccagcggatctggttctggttccggaagtgacaagacccatacttgccctccgtgccctgcgccggaactgctcggaggtcctagcgtctttcttttcccgccaaaacctaaggatacactcatgattagtcgaacccccgaagtgacgtgtgtagtcgtagacgttagccacgaagaccccgaagttaagttcaattggtacgtggatggcgtcgaggtacataacgctaaaaccaagcctcgagaggagcaatataactccacataccgagtggtctctgtgcttacggtgcttcaccaagattggctcaatggcaaagagtataagtgcaaggtgtctaataaggctctccctgctcccatagaaaagacgataagcaaagcaaagggacagccccgcgagccacaggtatacactctgccgccttctcgagatgagttgactaaaaaccaggtttccctcacctgtttggtcaaaggtttctatccgtctgacatcgctgtcgagtgggagagtaatggacagcctgagaacaactataagaccactccaccggtcttggacagcgatggatctttttttctgtactcaaaacttacagtagacaagtcacgatggcagcagggaaatgtcttttcctgctctgtaatgcacgaagcattgcataaccactatacgcagaaatccctttcattgtctccgggtaaaaaacaagagcactttcctgataacctgttgccgagctgggcgattacgcttatcagtgtaaacggcatctttgtaatatgctgtctgacctactgcttcgcaccaaggtgccgggagagaaggggatcctcccatcactgggggtacggcaaacacaacggacctgagcactggcataaggacttccccattgccaagggagagcgccagtcccctgttgacatcgacactcatacagccaagtatgacccttccctgaagcccctgtctgtttcctatgatcaagcaacttccctgagaatcctcaacaatggtcatgctttcaacgtggagtttgatgactctcaggacaaagcagtgctcaagggaggacccctggatggcacttacagattgattcagtttcactttcactggggttcacttgatggacaaggttcagagcatactgtggataaaaagaaatatgctgcagaacttcacttggttcactggaacaccaaatatggggattttgggaaagctgtgcagcaacctgatggactggccgttctaggtatttttttgaaggttggcagcgctaaaccgggccatcagaaagttgttgatgtgctggattccattaaaacaaagggcaagagtgctgacttcactaacttcgatcctcgtggcctccttcctgaatccctggattactggacctacccaggctcactgaccacccctcctcttctggaatgtgtgacctggattgtgctcaaggaacccatcagcgtcagcagcgagcaggtgttgaaattccgtaaacttaacttcaatggggagggtgaacccgaagaactgatggtggacaactggcgcccagctcagccactgaagaacaggcaaatcaaagcttccttcaaataa

SEQ ID NO: 6065 - protein, 1386 aa, Artificial Sequence
  source: /note="Description of Artificial Sequence: Synthetic Construct"
MALPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSATNFSLLKQAGDVEENPGPMCHQQLVISWFSLVFLASPLVAIWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSGGGGSRNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNASGSGSGSGSFSIPQANHSHSGDYHCTGNIGYTLYSSKPVTITVQAPLLPSWAITLISVNGIFVICCLTYCFAPRCRERRGSSHHWGYGKHNGPEHWHKDFPIAKGERQSPVDIDTHTAKYDPSLKPLSVSYDQATSLRILNNGHAFNVEFDDSQDKAVLKGGPLDGTYRLIQFHFHWGSLDGQGSEHTVDKKKYAAELHLVHWNTKYGDFGKAVQQPDGLAVLGIFLKVGSAKPGHQKVVDVLDSIKTKGKSADFTNFDPRGLLPESLDYWTYPGSLTTPPLLECVTWIVLKEPISVSSEQVLKFRKLNFNGEGEPEELMVDNWRPAQPLKNRQIKASFK

SEQ ID NO: 6066 - DNA, 4161 bp, Artificial Sequence
  source: /note="Description of Artificial Sequence: Synthetic Construct"
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggatcagctactaacttcagcctgctgaagcaggctggagacgtggaggagaaccctggacctatgtgccaccaacagctcgtgatcagctggttctccctggtgttcctggctagccccctggtggccatctgggagctcaagaaagacgtgtacgtggtggaactggactggtaccccgacgcccctggcgaaatggtggtgctgacatgcgacacccctgaggaggatggcattacctggaccctcgatcagagctccgaggtgctgggcagcggcaaaaccctgaccatccaggtgaaggagtttggcgatgccggccagtacacatgtcacaagggcggcgaggtgctgagccactccctgctgctgctccacaagaaggaagatggcatctggagcaccgacattctgaaggatcagaaggagcccaagaacaagacattcctgaggtgtgaggccaagaactacagcggcaggtttacctgctggtggctgacaacaatcagcaccgacctcacattctccgtcaagtcctccaggggttcttccgaccctcaaggcgtgacatgcggcgctgccaccctgagcgctgagagagtcaggggcgacaacaaggagtacgagtacagcgtcgaatgtcaggaggacagcgcctgtcccgccgctgaagagagcctgcctatcgaggtgatggtggacgccgtgcacaaactgaagtatgagaattacacctccagcttcttcatcagggacatcatcaaacccgatccccccaagaacctgcagctgaagcctctgaagaacagcagacaggtcgaagtgtcctgggagtaccctgatacctggtccacaccccacagctacttcagcctgaccttttgcgtgcaggtgcagggcaagagcaaaagggagaagaaggacagggtgtttaccgacaagacctccgccacagtgatttgcagaaagaacgcctccatcagcgtgagggcccaggacaggtattacagcagctcctggagcgaatgggctagcgtgccctgtagcggaggaggaggcagcggaggaggaggttctggaggaggcggcagcagaaacctgcctgtcgctacccccgaccccggaatgttcccctgcctgcaccactcccagaacctcctgagggccgtgtccaacatgctgcagaaggctagacagaccctcgaattctacccctgtaccagcgaggagatcgaccatgaggacatcaccaaggataagaccagcaccgtggaggcttgcctgcctctggagctgaccaaaaacgagagctgcctgaacagcagggaaaccagcttcattaccaacggctcctgcctggcctccaggaagacatccttcatgatggccctgtgcctcagcagcatctacgaggacctgaagatgtatcaggtggagtttaagaccatgaatgccaagctgctgatggaccctaagaggcagatcttcctggaccagaatatgctggccgtgattgacgagctgatgcaggccctcaactttaacagcgagaccgtgccccagaaaagcagcctcgaagagcctgacttctacaaaaccaagattaagctgtgtatcctgctgcacgccttcaggatcagggccgtgaccatcgacagggtgatgagctacctgaacgccagcggatctggttctggttccggaagtttttctatcccgcaagcgaatcacagccattctggtgattaccactgcacgggcaatatcggttacacactctactcctcaaagcccgtcacgataacggtgcaggcaccactgttgccgagctgggcgattacgcttatcagtgtaaacggcatctttgtaatatgctgtctgacctactgcttcgcaccaaggtgccgggagagaaggggatcctcccatcactgggggtacggcaaacacaacggacctgagcactggcataaggacttccccattgccaagggagagcgccagtcccctgttgacatcgacactcatacagccaagtatgacccttccctgaagcccctgtctgtttcctatgatcaagcaacttccctgagaatcctcaacaatggtcatgctttcaacgtggagtttgatgactctcaggacaaagcagtgctcaagggaggacccctggatggcacttacagattgattcagtttcactttcactggggttcacttgatggacaaggttcagagcatactgtggataaaaagaaatatgctgcagaacttcacttggttcactggaacaccaaatatggggattttgggaaagctgtgcagcaacctgatggactggccgttctaggtatttttttgaaggttggcagcgctaaaccgggccatcagaaagttgttgatgtgctggattccattaaaacaaagggcaagagtgctgacttcactaacttcgatcctcgtggcctccttcctgaatccctggattactggacctacccaggctcactgaccacccctcctcttctggaatgtgtgacctggattgtgctcaaggaacccatcagcgtcagcagcgagcaggtgttgaaattccgtaaacttaacttcaatggggagggtgaacccgaagaactgatggtggacaactggcgcccagctcagccactgaagaacaggcaaatcaaagcttccttcaaataa

SEQ ID NO: 6067 - protein, 1377 aa, Artificial Sequence
  Description of the Artificial Sequence: Synthetic construct
MALPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSATNFSLLKQAGDVEENPGPMCHQQLVISWFSLVFLASPLVAIWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSGGGGSRNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNASGSGSGSGSGSGSGSGSGSGSGSGSGSGSGSLDFACDLLPSWAITLISVNGIFVICCLTYCFAPRCRERRGSSHHWGYGKHNGPEHWHKDFPIAKGERQSPVDIDTHTAKYDPSLKPLSVSYDQATSLRILNNGHAFNVEFDDSQDKAVLKGGPLDGTYRLIQFHFHWGSLDGQGSEHTVDKKKYAAELHLVHWNTKYGDFGKAVQQPDGLAVLGIFLKVGSAKPGHQKVVDVLDSIKTKGKSADFTNFDPRGLLPESLDYWTYPGSLTTPPLLECVTWIVLKEPISVSSEQVLKFRKLNFNGEGEPEELMVDNWRPAQPLKNRQIKASFK

SEQ ID NO: 6068 - DNA, 4134 bp, Artificial Sequence
  Description of the Artificial Sequence: Synthetic construct
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggatcagctactaacttcagcctgctgaagcaggctggagacgtggaggagaaccctggacctatgtgccaccaacagctcgtgatcagctggttctccctggtgttcctggctagccccctggtggccatctgggagctcaagaaagacgtgtacgtggtggaactggactggtaccccgacgcccctggcgaaatggtggtgctgacatgcgacacccctgaggaggatggcattacctggaccctcgatcagagctccgaggtgctgggcagcggcaaaaccctgaccatccaggtgaaggagtttggcgatgccggccagtacacatgtcacaagggcggcgaggtgctgagccactccctgctgctgctccacaagaaggaagatggcatctggagcaccgacattctgaaggatcagaaggagcccaagaacaagacattcctgaggtgtgaggccaagaactacagcggcaggtttacctgctggtggctgacaacaatcagcaccgacctcacattctccgtcaagtcctccaggggttcttccgaccctcaaggcgtgacatgcggcgctgccaccctgagcgctgagagagtcaggggcgacaacaaggagtacgagtacagcgtcgaatgtcaggaggacagcgcctgtcccgccgctgaagagagcctgcctatcgaggtgatggtggacgccgtgcacaaactgaagtatgagaattacacctccagcttcttcatcagggacatcatcaaacccgatccccccaagaacctgcagctgaagcctctgaagaacagcagacaggtcgaagtgtcctgggagtaccctgatacctggtccacaccccacagctacttcagcctgaccttttgcgtgcaggtgcagggcaagagcaaaagggagaagaaggacagggtgtttaccgacaagacctccgccacagtgatttgcagaaagaacgcctccatcagcgtgagggcccaggacaggtattacagcagctcctggagcgaatgggctagcgtgccctgtagcggaggaggaggcagcggaggaggaggttctggaggaggcggcagcagaaacctgcctgtcgctacccccgaccccggaatgttcccctgcctgcaccactcccagaacctcctgagggccgtgtccaacatgctgcagaaggctagacagaccctcgaattctacccctgtaccagcgaggagatcgaccatgaggacatcaccaaggataagaccagcaccgtggaggcttgcctgcctctggagctgaccaaaaacgagagctgcctgaacagcagggaaaccagcttcattaccaacggctcctgcctggcctccaggaagacatccttcatgatggccctgtgcctcagcagcatctacgaggacctgaagatgtatcaggtggagtttaagaccatgaatgccaagctgctgatggaccctaagaggcagatcttcctggaccagaatatgctggccgtgattgacgagctgatgcaggccctcaactttaacagcgagaccgtgccccagaaaagcagcctcgaagagcctgacttctacaaaaccaagattaagctgtgtatcctgctgcacgccttcaggatcagggccgtgaccatcgacagggtgatgagctacctgaacgccagcggatctggttctggttccggaagtggatctggttcagggtccggtagtggatctgggtcaggaagtggaagcggtagtgggtctggatctctggactttgcctgcgatctgttgccgagctgggcgattacgcttatcagtgtaaacggcatctttgtaatatgctgtctgacctactgcttcgcaccaaggtgccgggagagaaggggatcctcccatcactgggggtacggcaaacacaacggacctgagcactggcataaggacttccccattgccaagggagagcgccagtcccctgttgacatcgacactcatacagccaagtatgacccttccctgaagcccctgtctgtttcctatgatcaagcaacttccctgagaatcctcaacaatggtcatgctttcaacgtggagtttgatgactctcaggacaaagcagtgctcaagggaggacccctggatggcacttacagattgattcagtttcactttcactggggttcacttgatggacaaggttcagagcatactgtggataaaaagaaatatgctgcagaacttcacttggttcactggaacaccaaatatggggattttgggaaagctgtgcagcaacctgatggactggccgttctaggtatttttttgaaggttggcagcgctaaaccgggccatcagaaagttgttgatgtgctggattccattaaaacaaagggcaagagtgctgacttcactaacttcgatcctcgtggcctccttcctgaatccctggattactggacctacccaggctcactgaccacccctcctcttctggaatgtgtgacctggattgtgctcaaggaacccatcagcgtcagcagcgagcaggtgttgaaattccgtaaacttaacttcaatggggagggtgaacccgaagaactgatggtggacaactggcgcccagctcagccactgaagaacaggcaaatcaaagcttccttcaaataa

SEQ ID NO: 6069 - protein, 1407 aa, Artificial Sequence
  Description of the Artificial Sequence: Synthetic construct
MALPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSATNFSLLKQAGDVEENPGPMCHQQLVISWFSLVFLASPLVAIWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSGGGGSRNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNASGSGSGSGSGSGSGSGSGSGSGSGSGSGSGSTTTPAPRPPTPAPTIASQPLSLRPEACRPAAGGAVHTRGLDFACDIYIWAPLAGTCGVLLLSLVITLYCGSSHHWGYGKHNGPEHWHKDFPIAKGERQSPVDIDTHTAKYDPSLKPLSVSYDQATSLRILNNGHAFNVEFDDSQDKAVLKGGPLDGTYRLIQFHFHWGSLDGQGSEHTVDKKKYAAELHLVHWNTKYGDFGKAVQQPDGLAVLGIFLKVGSAKPGHQKVVDVLDSIKTKGKCADFTNYDPRGLLPDSLDYWTYPGSLTTPPLLECVTWIVLKEPISVSSEQVLKFRKLNFNGEGEPEELMVDNWRPAQPLKNRQIKASFK

SEQ ID NO: 6070 - DNA, 4224 bp, Artificial Sequence
  Description of the Artificial Sequence: Synthetic construct
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggatcagctactaacttcagcctgctgaagcaggctggagacgtggaggagaaccctggacctatgtgccaccaacagctcgtgatcagctggttctccctggtgttcctggctagccccctggtggccatctgggagctcaagaaagacgtgtacgtggtggaactggactggtaccccgacgcccctggcgaaatggtggtgctgacatgcgacacccctgaggaggatggcattacctggaccctcgatcagagctccgaggtgctgggcagcggcaaaaccctgaccatccaggtgaaggagtttggcgatgccggccagtacacatgtcacaagggcggcgaggtgctgagccactccctgctgctgctccacaagaaggaagatggcatctggagcaccgacattctgaaggatcagaaggagcccaagaacaagacattcctgaggtgtgaggccaagaactacagcggcaggtttacctgctggtggctgacaacaatcagcaccgacctcacattctccgtcaagtcctccaggggttcttccgaccctcaaggcgtgacatgcggcgctgccaccctgagcgctgagagagtcaggggcgacaacaaggagtacgagtacagcgtcgaatgtcaggaggacagcgcctgtcccgccgctgaagagagcctgcctatcgaggtgatggtggacgccgtgcacaaactgaagtatgagaattacacctccagcttcttcatcagggacatcatcaaacccgatccccccaagaacctgcagctgaagcctctgaagaacagcagacaggtcgaagtgtcctgggagtaccctgatacctggtccacaccccacagctacttcagcctgaccttttgcgtgcaggtgcagggcaagagcaaaagggagaagaaggacagggtgtttaccgacaagacctccgccacagtgatttgcagaaagaacgcctccatcagcgtgagggcccaggacaggtattacagcagctcctggagcgaatgggctagcgtgccctgtagcggaggaggaggcagcggaggaggaggttctggaggaggcggcagcagaaacctgcctgtcgctacccccgaccccggaatgttcccctgcctgcaccactcccagaacctcctgagggccgtgtccaacatgctgcagaaggctagacagaccctcgaattctacccctgtaccagcgaggagatcgaccatgaggacatcaccaaggataagaccagcaccgtggaggcttgcctgcctctggagctgaccaaaaacgagagctgcctgaacagcagggaaaccagcttcattaccaacggctcctgcctggcctccaggaagacatccttcatgatggccctgtgcctcagcagcatctacgaggacctgaagatgtatcaggtggagtttaagaccatgaatgccaagctgctgatggaccctaagaggcagatcttcctggaccagaatatgctggccgtgattgacgagctgatgcaggccctcaactttaacagcgagaccgtgccccagaaaagcagcctcgaagagcctgacttctacaaaaccaagattaagctgtgtatcctgctgcacgccttcaggatcagggccgtgaccatcgacagggtgatgagctacctgaacgccagcggatctggttctggttccggaagtggatctggttcagggtccggtagtggatctgggtcaggaagtggaagcggtagtgggtctggatctaccacaaccccagcacctcgcccaccaacaccagcaccaaccatcgcatcccagccactgtctctgaggcccgaggcatgtaggcctgcagcaggaggcgccgtgcacaccaggggcctggactttgcctgcgatatctatatctgggcaccactggcaggaacatgtggcgtgctgctgctgtccctggtcatcaccctgtattgcggatcctcccatcactgggggtacggcaaacacaacggacctgagcactggcataaggacttccccattgccaagggagagcgccagtcccctgttgacatcgacactcatacagccaagtatgacccttccctgaagcccctgtctgtttcctatgatcaagcaacttccctgaggatcctcaacaatggtcatgctttcaacgtggagtttgatgactctcaggacaaagcagtgctcaagggaggacccctggatggcacttacagattgattcagtttcactttcactggggttcacttgatggacaaggttcagagcatactgtggataaaaagaaatatgctgcagaacttcacttggttcactggaacaccaaatatggggattttgggaaagctgtgcagcaacctgatggactggccgttctaggtatttttttgaaggttggcagcgctaaaccgggccatcagaaagttgttgatgtgctggattccattaaaacaaagggcaagtgtgctgacttcactaactacgatcctcgtggcctccttcctgattccctggattactggacctacccaggctcactgaccacccctcctcttctggaatgtgtgacctggattgtgctcaaggaacccatcagcgtcagcagcgagcaggtgttgaaattccgtaaacttaacttcaatggggagggtgaacccgaagaactgatggtggacaactggcgcccagctcagccactgaagaacaggcaaatcaaagcttccttcaaatga

SEQ ID NO: 6071 - protein, 1407 aa, Artificial Sequence
  Description of the Artificial Sequence: Synthetic construct
MALPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSATNFSLLKQAGDVEENPGPMCHQQLVISWFSLVFLASPLVAIWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSGGGGSRNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNASGSGSGSGSGSGSGSGSGSGSGSGSGSGSGSTTTPAPRPPTPAPTIASQPLSLRPEACRPAAGGAVHTRGLDFACDIYIWAPLAGTCGVLLLSLVITLYCGSSHHWGYGKHNGPEHWHKDFPIAKGERQSPVDIDTHTAKYDPSLKPLSVSYDQATSLRILNNGHAFNVEFDFSQDKAVLKGGPLDGTYRLIQFHFHWGSLDGQGSEHTVDKKKYAAELHLVHWNTKYGDFGKAVQQPDGLAVLGIFLKVGSAKPGLQKVVDVLDSIKTKGKSADFTNFDPRGLLPESLDYWTYPGSLTTPPLLECVTWIVLKEPISVSSEQVLKFRKLNFNGEGEPEELMFDNWRPAQLLKNRQIKASFK

SEQ ID NO: 6072 - DNA, 4224 bp, Artificial Sequence
  Description of the Artificial Sequence: Synthetic construct
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggatcagctactaacttcagcctgctgaagcaggctggagacgtggaggagaaccctggacctatgtgccaccaacagctcgtgatcagctggttctccctggtgttcctggctagccccctggtggccatctgggagctcaagaaagacgtgtacgtggtggaactggactggtaccccgacgcccctggcgaaatggtggtgctgacatgcgacacccctgaggaggatggcattacctggaccctcgatcagagctccgaggtgctgggcagcggcaaaaccctgaccatccaggtgaaggagtttggcgatgccggccagtacacatgtcacaagggcggcgaggtgctgagccactccctgctgctgctccacaagaaggaagatggcatctggagcaccgacattctgaaggatcagaaggagcccaagaacaagacattcctgaggtgtgaggccaagaactacagcggcaggtttacctgctggtggctgacaacaatcagcaccgacctcacattctccgtcaagtcctccaggggttcttccgaccctcaaggcgtgacatgcggcgctgccaccctgagcgctgagagagtcaggggcgacaacaaggagtacgagtacagcgtcgaatgtcaggaggacagcgcctgtcccgccgctgaagagagcctgcctatcgaggtgatggtggacgccgtgcacaaactgaagtatgagaattacacctccagcttcttcatcagggacatcatcaaacccgatccccccaagaacctgcagctgaagcctctgaagaacagcagacaggtcgaagtgtcctgggagtaccctgatacctggtccacaccccacagctacttcagcctgaccttttgcgtgcaggtgcagggcaagagcaaaagggagaagaaggacagggtgtttaccgacaagacctccgccacagtgatttgcagaaagaacgcctccatcagcgtgagggcccaggacaggtattacagcagctcctggagcgaatgggctagcgtgccctgtagcggaggaggaggcagcggaggaggaggttctggaggaggcggcagcagaaacctgcctgtcgctacccccgaccccggaatgttcccctgcctgcaccactcccagaacctcctgagggccgtgtccaacatgctgcagaaggctagacagaccctcgaattctacccctgtaccagcgaggagatcgaccatgaggacatcaccaaggataagaccagcaccgtggaggcttgcctgcctctggagctgaccaaaaacgagagctgcctgaacagcagggaaaccagcttcattaccaacggctcctgcctggcctccaggaagacatccttcatgatggccctgtgcctcagcagcatctacgaggacctgaagatgtatcaggtggagtttaagaccatgaatgccaagctgctgatggaccctaagaggcagatcttcctggaccagaatatgctggccgtgattgacgagctgatgcaggccctcaactttaacagcgagaccgtgccccagaaaagcagcctcgaagagcctgacttctacaaaaccaagattaagctgtgtatcctgctgcacgccttcaggatcagggccgtgaccatcgacagggtgatgagctacctgaacgccagcggatctggttctggttccggaagtggatctggttcagggtccggtagtggatctgggtcaggaagtggaagcggtagtgggtctggatctaccacaaccccagcacctcgcccaccaacaccagcaccaaccatcgcatcccagccactgtctctgaggcccgaggcatgtaggcctgcagcaggaggcgccgtgcacaccaggggcctggactttgcctgcgatatctatatctgggcaccactggcaggaacatgtggcgtgctgctgctgtccctggtcatcaccctgtattgcggatcctcccatcactgggggtacggcaaacacaacggacctgagcactggcataaggacttccccattgccaagggagagcgccagtcccctgttgacatcgacactcatacagccaagtatgacccttccctgaagcccctgtctgtttcctatgatcaagcaacttccctgaggatcctcaacaatggtcatgctttcaacgtggagtttgatttttctcaggacaaagcagtgctcaagggaggacccctggatggcacttacagattgattcagtttcactttcactggggttcacttgatggacaaggttcagagcatactgtggataaaaagaaatatgctgcagaacttcacttggttcactggaacaccaaatatggggattttgggaaagctgtgcagcaacctgatggactggccgttctaggtatttttttgaaggttggcagcgctaaaccgggccttcagaaagttgttgatgtgctggattccattaaaacaaagggcaagagtgctgacttcactaacttcgatcctcgtggcctccttcctgaatccctggattactggacctacccaggctcactgaccacccctcctcttctggaatgtgtgacctggattgtgctcaaggaacccatcagcgtcagcagcgagcaggtgttgaaattccgtaaacttaacttcaatggggagggtgaacccgaagaactgatgtttgacaactggcgcccagctcagttgctgaagaacaggcaaatcaaagcttccttcaaatga

SEQ ID NO: 6073 - protein, 1407 aa, Artificial Sequence; identical to SEQ ID NO: 5970
  Description of the Artificial Sequence: Synthetic construct

SEQ ID NO: 6074 - DNA, 4224 bp, Artificial Sequence; identical to SEQ ID NO: 5971
  Description of the Artificial Sequence: Synthetic construct

SEQ ID NO: 6075 - protein, 1407 aa, Artificial Sequence; identical to SEQ ID NO: 5972
  Description of the Artificial Sequence: Synthetic construct

SEQ ID NO: 6076 - DNA, 4224 bp, Artificial Sequence; identical to SEQ ID NO: 5973
  Description of the Artificial Sequence: Synthetic construct

SEQ ID NO: 6077 - protein, 1377 aa, Artificial Sequence; identical to SEQ ID NO: 6067
  Description of the Artificial Sequence: Synthetic construct

SEQ ID NO: 6078 - DNA, 4134 bp, Artificial Sequence; identical to SEQ ID NO: 6068
  Description of the Artificial Sequence: Synthetic construct

SEQ ID NO: 6079 - protein, 1118 aa, Artificial Sequence
  Description of the Artificial Sequence: Synthetic construct
MALPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSATNFSLLKQAGDVEENPGPMCHQQLVISWFSLVFLASPLVAIWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSGGGGSRNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNASGSGSGSGSGSGSGSGSGSGSGSGSGSGSGSLDFACDLLPSWAITLISVNGIFVICCLTYCFAPRCRERRGS

SEQ ID NO: 6080 - DNA, 3357 bp, Artificial Sequence
  Description of the Artificial Sequence: Synthetic construct
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggatcagctactaacttcagcctgctgaagcaggctggagacgtggaggagaaccctggacctatgtgccaccaacagctcgtgatcagctggttctccctggtgttcctggctagccccctggtggccatctgggagctcaagaaagacgtgtacgtggtggaactggactggtaccccgacgcccctggcgaaatggtggtgctgacatgcgacacccctgaggaggatggcattacctggaccctcgatcagagctccgaggtgctgggcagcggcaaaaccctgaccatccaggtgaaggagtttggcgatgccggccagtacacatgtcacaagggcggcgaggtgctgagccactccctgctgctgctccacaagaaggaagatggcatctggagcaccgacattctgaaggatcagaaggagcccaagaacaagacattcctgaggtgtgaggccaagaactacagcggcaggtttacctgctggtggctgacaacaatcagcaccgacctcacattctccgtcaagtcctccaggggttcttccgaccctcaaggcgtgacatgcggcgctgccaccctgagcgctgagagagtcaggggcgacaacaaggagtacgagtacagcgtcgaatgtcaggaggacagcgcctgtcccgccgctgaagagagcctgcctatcgaggtgatggtggacgccgtgcacaaactgaagtatgagaattacacctccagcttcttcatcagggacatcatcaaacccgatccccccaagaacctgcagctgaagcctctgaagaacagcagacaggtcgaagtgtcctgggagtaccctgatacctggtccacaccccacagctacttcagcctgaccttttgcgtgcaggtgcagggcaagagcaaaagggagaagaaggacagggtgtttaccgacaagacctccgccacagtgatttgcagaaagaacgcctccatcagcgtgagggcccaggacaggtattacagcagctcctggagcgaatgggctagcgtgccctgtagcggaggaggaggcagcggaggaggaggttctggaggaggcggcagcagaaacctgcctgtcgctacccccgaccccggaatgttcccctgcctgcaccactcccagaacctcctgagggccgtgtccaacatgctgcagaaggctagacagaccctcgaattctacccctgtaccagcgaggagatcgaccatgaggacatcaccaaggataagaccagcaccgtggaggcttgcctgcctctggagctgaccaaaaacgagagctgcctgaacagcagggaaaccagcttcattaccaacggctcctgcctggcctccaggaagacatccttcatgatggccctgtgcctcagcagcatctacgaggacctgaagatgtatcaggtggagtttaagaccatgaatgccaagctgctgatggaccctaagaggcagatcttcctggaccagaatatgctggccgtgattgacgagctgatgcaggccctcaactttaacagcgagaccgtgccccagaaaagcagcctcgaagagcctgacttctacaaaaccaagattaagctgtgtatcctgctgcacgccttcaggatcagggccgtgaccatcgacagggtgatgagctacctgaacgccagcggatctggttctggttccggaagtggatctggttcagggtccggtagtggatctgggtcaggaagtggaagcggtagtgggtctggatctctggactttgcctgcgatctgttgccgagctgggcgattacgcttatcagtgtaaacggcatctttgtaatatgctgtctgacctactgcttcgcaccaaggtgccgggagagaaggggatcctga

SEQ ID NO: 6081 - DNA, 3709 bp, Artificial Sequence
  Description of the Artificial Sequence: Synthetic construct
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaaatcgggctagccgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtgcacatgctttacatgtgtttagtcgaggttaaaaaaacgtctaggccccccgaaccacggggacgtggttttcctttgaaaaacacgatgataagcttgccacaacccacaaggagacgaccttccatgtgccaccaacagctcgtgatcagctggttctccctggtgttcctggctagccccctggtggccatctgggagctcaagaaagacgtgtacgtggtggaactggactggtaccccgacgcccctggcgaaatggtggtgctgacatgcgacacccctgaggaggatggcattacctggaccctcgatcagagctccgaggtgctgggcagcggcaaaaccctgaccatccaggtgaaggagtttggcgatgccggccagtacacatgtcacaagggcggcgaggtgctgagccactccctgctgctgctccacaagaaggaagatggcatctggagcaccgacattctgaaggatcagaaggagcccaagaacaagacattcctgaggtgtgaggccaagaactacagcggcaggtttacctgctggtggctgacaacaatcagcaccgacctcacattctccgtcaagtcctccaggggttcttccgaccctcaaggcgtgacatgcggcgctgccaccctgagcgctgagagagtcaggggcgacaacaaggagtacgagtacagcgtcgaatgtcaggaggacagcgcctgtcccgccgctgaagagagcctgcctatcgaggtgatggtggacgccgtgcacaaactgaagtatgagaattacacctccagcttcttcatcagggacatcatcaaacccgatccccccaagaacctgcagctgaagcctctgaagaacagcagacaggtcgaagtgtcctgggagtaccctgatacctggtccacaccccacagctacttcagcctgaccttttgcgtgcaggtgcagggcaagagcaaaagggagaagaaggacagggtgtttaccgacaagacctccgccacagtgatttgcagaaagaacgcctccatcagcgtgagggcccaggacaggtattacagcagctcctggagcgaatgggctagcgtgccctgtagcggaggaggaggcagcggaggaggaggttctggaggaggcggcagcagaaacctgcctgtcgctacccccgaccccggaatgttcccctgcctgcaccactcccagaacctcctgagggccgtgtccaacatgctgcagaaggctagacagaccctcgaattctacccctgtaccagcgaggagatcgaccatgaggacatcaccaaggataagaccagcaccgtggaggcttgcctgcctctggagctgaccaaaaacgagagctgcctgaacagcagggaaaccagcttcattaccaacggctcctgcctggcctccaggaagacatccttcatgatggccctgtgcctcagcagcatctacgaggacctgaagatgtatcaggtggagtttaagaccatgaatgccaagctgctgatggaccctaagaggcagatcttcctggaccagaatatgctggccgtgattgacgagctgatgcaggccctcaactttaacagcgagaccgtgccccagaaaagcagcctcgaagagcctgacttctacaaaaccaagattaagctgtgtatcctgctgcacgccttcaggatcagggccgtgaccatcgacagggtgatgagctacctgaacgccagcggatcctaa

SEQ ID NO: 6082 - protein, 486 aa, Artificial Sequence; identical to SEQ ID NO: 1757
  Description of the Artificial Sequence: Synthetic construct

SEQ ID NO: 6083 - DNA, 1461 bp, Artificial Sequence; identical to SEQ ID NO: 5981
  Description of the Artificial Sequence: Synthetic construct

SEQ ID NO: 6084 - protein, 542 aa, Artificial Sequence
  Description of the Artificial Sequence: Synthetic construct
MCHQQLVISWFSLVFLASPLVAIWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSGGGGSRNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNASGS

SEQ ID NO: 6085 - DNA, 1629 bp, Artificial Sequence
  Description of the Artificial Sequence: Synthetic construct
atgtgccaccaacagctcgtgatcagctggttctccctggtgttcctggctagccccctggtggccatctgggagctcaagaaagacgtgtacgtggtggaactggactggtaccccgacgcccctggcgaaatggtggtgctgacatgcgacacccctgaggaggatggcattacctggaccctcgatcagagctccgaggtgctgggcagcggcaaaaccctgaccatccaggtgaaggagtttggcgatgccggccagtacacatgtcacaagggcggcgaggtgctgagccactccctgctgctgctccacaagaaggaagatggcatctggagcaccgacattctgaaggatcagaaggagcccaagaacaagacattcctgaggtgtgaggccaagaactacagcggcaggtttacctgctggtggctgacaacaatcagcaccgacctcacattctccgtcaagtcctccaggggttcttccgaccctcaaggcgtgacatgcggcgctgccaccctgagcgctgagagagtcaggggcgacaacaaggagtacgagtacagcgtcgaatgtcaggaggacagcgcctgtcccgccgctgaagagagcctgcctatcgaggtgatggtggacgccgtgcacaaactgaagtatgagaattacacctccagcttcttcatcagggacatcatcaaacccgatccccccaagaacctgcagctgaagcctctgaagaacagcagacaggtcgaagtgtcctgggagtaccctgatacctggtccacaccccacagctacttcagcctgaccttttgcgtgcaggtgcagggcaagagcaaaagggagaagaaggacagggtgtttaccgacaagacctccgccacagtgatttgcagaaagaacgcctccatcagcgtgagggcccaggacaggtattacagcagctcctggagcgaatgggctagcgtgccctgtagcggaggaggaggcagcggaggaggaggttctggaggaggcggcagcagaaacctgcctgtcgctacccccgaccccggaatgttcccctgcctgcaccactcccagaacctcctgagggccgtgtccaacatgctgcagaaggctagacagaccctcgaattctacccctgtaccagcgaggagatcgaccatgaggacatcaccaaggataagaccagcaccgtggaggcttgcctgcctctggagctgaccaaaaacgagagctgcctgaacagcagggaaaccagcttcattaccaacggctcctgcctggcctccaggaagacatccttcatgatggccctgtgcctcagcagcatctacgaggacctgaagatgtatcaggtggagtttaagaccatgaatgccaagctgctgatggaccctaagaggcagatcttcctggaccagaatatgctggccgtgattgacgagctgatgcaggccctcaactttaacagcgagaccgtgccccagaaaagcagcctcgaagagcctgacttctacaaaaccaagattaagctgtgtatcctgctgcacgccttcaggatcagggccgtgaccatcgacagggtgatgagctacctgaacgccagcggatcctaa

SEQ ID NO: 6086 - protein, 486 aa, Artificial Sequence; identical to SEQ ID NO: 1757
  Description of the Artificial Sequence: Synthetic construct

SEQ ID NO: 6087 - DNA, 1461 bp, Artificial Sequence; identical to SEQ ID NO: 5981
  Description of the Artificial Sequence: Synthetic construct

SEQ ID NO: 6088 - protein, 1193 aa, Artificial Sequence
  Description of the Artificial Sequence: Synthetic construct
MALPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSATNFSLLKQAGDVEENPGPMCHQQLVISWFSLVFLASPLVAIWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSGGGGSRNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNASGSGSGSGSADFPTPSISDFEIPTSNIRRIICSTSGGFPEPHLSWLENGEELNAINTTVSQDPETELYAVSSKLDFNMTTNHSFMCLIKYGHLRVNQTFNWNTTKQEHFPDNLLPSWAITLISVNGIFVICCLTYCFAPRCRERRGS

SEQ ID NO: 6089 - DNA, 3582 bp, Artificial Sequence
  Description of the Artificial Sequence: Synthetic construct
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggatcagctactaacttcagcctgctgaagcaggctggagacgtggaggagaaccctggacctatgtgccaccaacagctcgtgatcagctggttctccctggtgttcctggctagccccctggtggccatctgggagctcaagaaagacgtgtacgtggtggaactggactggtaccccgacgcccctggcgaaatggtggtgctgacatgcgacacccctgaggaggatggcattacctggaccctcgatcagagctccgaggtgctgggcagcggcaaaaccctgaccatccaggtgaaggagtttggcgatgccggccagtacacatgtcacaagggcggcgaggtgctgagccactccctgctgctgctccacaagaaggaagatggcatctggagcaccgacattctgaaggatcagaaggagcccaagaacaagacattcctgaggtgtgaggccaagaactacagcggcaggtttacctgctggtggctgacaacaatcagcaccgacctcacattctccgtcaagtcctccaggggttcttccgaccctcaaggcgtgacatgcggcgctgccaccctgagcgctgagagagtcaggggcgacaacaaggagtacgagtacagcgtcgaatgtcaggaggacagcgcctgtcccgccgctgaagagagcctgcctatcgaggtgatggtggacgccgtgcacaaactgaagtatgagaattacacctccagcttcttcatcagggacatcatcaaacccgatccccccaagaacctgcagctgaagcctctgaagaacagcagacaggtcgaagtgtcctgggagtaccctgatacctggtccacaccccacagctacttcagcctgaccttttgcgtgcaggtgcagggcaagagcaaaagggagaagaaggacagggtgtttaccgacaagacctccgccacagtgatttgcagaaagaacgcctccatcagcgtgagggcccaggacaggtattacagcagctcctggagcgaatgggctagcgtgccctgtagcggaggaggaggcagcggaggaggaggttctggaggaggcggcagcagaaacctgcctgtcgctacccccgaccccggaatgttcccctgcctgcaccactcccagaacctcctgagggccgtgtccaacatgctgcagaaggctagacagaccctcgaattctacccctgtaccagcgaggagatcgaccatgaggacatcaccaaggataagaccagcaccgtggaggcttgcctgcctctggagctgaccaaaaacgagagctgcctgaacagcagggaaaccagcttcattaccaacggctcctgcctggcctccaggaagacatccttcatgatggccctgtgcctcagcagcatctacgaggacctgaagatgtatcaggtggagtttaagaccatgaatgccaagctgctgatggaccctaagaggcagatcttcctggaccagaatatgctggccgtgattgacgagctgatgcaggccctcaactttaacagcgagaccgtgccccagaaaagcagcctcgaagagcctgacttctacaaaaccaagattaagctgtgtatcctgctgcacgccttcaggatcagggccgtgaccatcgacagggtgatgagctacctgaacgccagcggatctggttctggttccggaagtgccgacttcccaacgccaagtatttcagattttgagatacccactagcaatataagacgcatcatctgttcaacctctgggggtttccccgagccccatctgtcttggctggaaaacggggaagaacttaatgctataaacactactgtttctcaagatcccgaaactgaactctatgctgtatccagcaaactcgacttcaatatgactacgaaccattcctttatgtgtcttattaagtatggccacttgcgcgtcaaccaaacctttaattggaatactactaaacaagagcactttcctgataacctgttgccgagctgggcgattacgcttatcagtgtaaacggcatctttgtaatatgctgtctgacctactgcttcgcaccaaggtgccgggagagaaggggatcctga

SEQ ID NO: 6090 - protein, 1325 aa, Artificial Sequence
  Description of the Artificial Sequence: Synthetic construct
MALPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSATNFSLLKQAGDVEENPGPMCHQQLVISWFSLVFLASPLVAIWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSGGGGSRNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNASGSGSGSGSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKKQEHFPDNLLPSWAITLISVNGIFVICCLTYCFAPRCRERRGS

SEQ ID NO: 6091 - DNA, 3978 bp, Artificial Sequence
  Description of the Artificial Sequence: Synthetic construct
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggatcagctactaacttcagcctgctgaagcaggctggagacgtggaggagaaccctggacctatgtgccaccaacagctcgtgatcagctggttctccctggtgttcctggctagccccctggtggccatctgggagctcaagaaagacgtgtacgtggtggaactggactggtaccccgacgcccctggcgaaatggtggtgctgacatgcgacacccctgaggaggatggcattacctggaccctcgatcagagctccgaggtgctgggcagcggcaaaaccctgaccatccaggtgaaggagtttggcgatgccggccagtacacatgtcacaagggcggcgaggtgctgagccactccctgctgctgctccacaagaaggaagatggcatctggagcaccgacattctgaaggatcagaaggagcccaagaacaagacattcctgaggtgtgaggccaagaactacagcggcaggtttacctgctggtggctgacaacaatcagcaccgacctcacattctccgtcaagtcctccaggggttcttccgaccctcaaggcgtgacatgcggcgctgccaccctgagcgctgagagagtcaggggcgacaacaaggagtacgagtacagcgtcgaatgtcaggaggacagcgcctgtcccgccgctgaagagagcctgcctatcgaggtgatggtggacgccgtgcacaaactgaagtatgagaattacacctccagcttcttcatcagggacatcatcaaacccgatccccccaagaacctgcagctgaagcctctgaagaacagcagacaggtcgaagtgtcctgggagtaccctgatacctggtccacaccccacagctacttcagcctgaccttttgcgtgcaggtgcagggcaagagcaaaagggagaagaaggacagggtgtttaccgacaagacctccgccacagtgatttgcagaaagaacgcctccatcagcgtgagggcccaggacaggtattacagcagctcctggagcgaatgggctagcgtgccctgtagcggaggaggaggcagcggaggaggaggttctggaggaggcggcagcagaaacctgcctgtcgctacccccgaccccggaatgttcccctgcctgcaccactcccagaacctcctgagggccgtgtccaacatgctgcagaaggctagacagaccctcgaattctacccctgtaccagcgaggagatcgaccatgaggacatcaccaaggataagaccagcaccgtggaggcttgcctgcctctggagctgaccaaaaacgagagctgcctgaacagcagggaaaccagcttcattaccaacggctcctgcctggcctccaggaagacatccttcatgatggccctgtgcctcagcagcatctacgaggacctgaagatgtatcaggtggagtttaagaccatgaatgccaagctgctgatggaccctaagaggcagatcttcctggaccagaatatgctggccgtgattgacgagctgatgcaggccctcaactttaacagcgagaccgtgccccagaaaagcagcctcgaagagcctgacttctacaaaaccaagattaagctgtgtatcctgctgcacgccttcaggatcagggccgtgaccatcgacagggtgatgagctacctgaacgccagcggatctggttctggttccggaagtgacaagacccatacttgccctccgtgccctgcgccggaactgctcggaggtcctagcgtctttcttttcccgccaaaacctaaggatacactcatgattagtcgaacccccgaagtgacgtgtgtagtcgtagacgttagccacgaagaccccgaagttaagttcaattggtacgtggatggcgtcgaggtacataacgctaaaaccaagcctcgagaggagcaatataactccacataccgagtggtctctgtgcttacggtgcttcaccaagattggctcaatggcaaagagtataagtgcaaggtgtctaataaggctctccctgctcccatagaaaagacgataagcaaagcaaagggacagccccgcgagccacaggtatacactctgccgccttctcgagatgagttgactaaaaaccaggtttccctcacctgtttggtcaaaggtttctatccgtctgacatcgctgtcgagtgggagagtaatggacagcctgagaacaactataagaccactccaccggtcttggacagcgatggatctttttttctgtactcaaaacttacagtagacaagtcacgatggcagcagggaaatgtcttttcctgctctgtaatgcacgaagcattgcataaccactatacgcagaaatccctttcattgtctccgggtaaaaaacaagagcactttcctgataacctgttgccgagctgggcgattacgcttatcagtgtaaacggcatctttgtaatatgctgtctgacctactgcttcgcaccaaggtgccgggagagaaggggatcctga

SEQ ID NO: 6092 - protein, 1049 aa, Artificial Sequence
  Description of the Artificial Sequence: Synthetic construct
MALPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSATNFSLLKQAGDVEENPGPMCHQQLVISWFSLVFLASPLVAIWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSGGGGSRNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNASGS

SEQ ID NO: 6093 - DNA, 3150 bp, Artificial Sequence
  Description of the Artificial Sequence: Synthetic construct
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggatcagctactaacttcagcctgctgaagcaggctggagacgtggaggagaaccctggacctatgtgccaccaacagctcgtgatcagctggttctccctggtgttcctggctagccccctggtggccatctgggagctcaagaaagacgtgtacgtggtggaactggactggtaccccgacgcccctggcgaaatggtggtgctgacatgcgacacccctgaggaggatggcattacctggaccctcgatcagagctccgaggtgctgggcagcggcaaaaccctgaccatccaggtgaaggagtttggcgatgccggccagtacacatgtcacaagggcggcgaggtgctgagccactccctgctgctgctccacaagaaggaagatggcatctggagcaccgacattctgaaggatcagaaggagcccaagaacaagacattcctgaggtgtgaggccaagaactacagcggcaggtttacctgctggtggctgacaacaatcagcaccgacctcacattctccgtcaagtcctccaggggttcttccgaccctcaaggcgtgacatgcggcgctgccaccctgagcgctgagagagtcaggggcgacaacaaggagtacgagtacagcgtcgaatgtcaggaggacagcgcctgtcccgccgctgaagagagcctgcctatcgaggtgatggtggacgccgtgcacaaactgaagtatgagaattacacctccagcttcttcatcagggacatcatcaaacccgatccccccaagaacctgcagctgaagcctctgaagaacagcagacaggtcgaagtgtcctgggagtaccctgatacctggtccacaccccacagctacttcagcctgaccttttgcgtgcaggtgcagggcaagagcaaaagggagaagaaggacagggtgtttaccgacaagacctccgccacagtgatttgcagaaagaacgcctccatcagcgtgagggcccaggacaggtattacagcagctcctggagcgaatgggctagcgtgccctgtagcggaggaggaggcagcggaggaggaggttctggaggaggcggcagcagaaacctgcctgtcgctacccccgaccccggaatgttcccctgcctgcaccactcccagaacctcctgagggccgtgtccaacatgctgcagaaggctagacagaccctcgaattctacccctgtaccagcgaggagatcgaccatgaggacatcaccaaggataagaccagcaccgtggaggcttgcctgcctctggagctgaccaaaaacgagagctgcctgaacagcagggaaaccagcttcattaccaacggctcctgcctggcctccaggaagacatccttcatgatggccctgtgcctcagcagcatctacgaggacctgaagatgtatcaggtggagtttaagaccatgaatgccaagctgctgatggaccctaagaggcagatcttcctggaccagaatatgctggccgtgattgacgagctgatgcaggccctcaactttaacagcgagaccgtgccccagaaaagcagcctcgaagagcctgacttctacaaaaccaagattaagctgtgtatcctgctgcacgccttcaggatcagggccgtgaccatcgacagggtgatgagctacctgaacgccagcggatcctga

SEQ ID NO: 6094 - protein, 259 aa, Artificial Sequence
  source: /note="Description of Artificial Sequence: Synthetic Destabilizing Domain (DD)"
SHHWGYGKHNGPEHWHKDFPIAKGERQSPVDIDTHTAKYDPSLKPLSVSYDQATSLRILNNGHAFNVEFDDSQDKAVLKGGPLDGTYRLIQFHFHWGSLDGQGSDHTVDKKKYAAELHLVHWNTKYGDFGKAVQQPDGLAVLGIFLKVGSAKPGLQKVVDVLDSIKTKGKSADFTNFDPRGLLPESLDYWTYPGSLTTPPLLECVTWIVLKEPISVSSEQVLKFRKLNFNGEGEPEELMVDNWRPAQPLKNRQIKASFK

SEQ ID NO: 6095 - protein, 259 aa, Artificial Sequence; identical to SEQ ID NO: 5757
  source: /note="Description of Artificial Sequence: Synthetic Destabilizing Domain (DD)"

SEQ ID NO: 6096 - protein, 259 aa, Artificial Sequence; identical to SEQ ID NO: 5879
  source: /note="Description of Artificial Sequence: Synthetic Destabilizing Domain (DD)"

SEQ ID NO: 6097 - protein, 259 aa, Artificial Sequence; identical to SEQ ID NO: 5875
  source: /note="Description of Artificial Sequence: Synthetic Destabilizing Domain (DD)"

SEQ ID NO: 6098 - protein, 259 aa, Artificial Sequence; identical to SEQ ID NO: 5759
  source: /note="Description of Artificial Sequence: Synthetic Destabilizing Domain (DD)"

SEQ ID NO: 6099 - protein, 259 aa, Artificial Sequence; identical to SEQ ID NO: 5821
  source: /note="Description of Artificial Sequence: Synthetic Destabilizing Domain (DD)"

SEQ ID NO: 6100 - protein, 259 aa, Artificial Sequence
  source: /note="Description of Artificial Sequence: Synthetic Destabilizing Domain (DD)"
SHHWGYGKHNGPEHWHKDFPIAKGERQSPVDIDTHTAKYDPSLKPLSVSYDQATSLRNLNNGHAFNVEFDDSQDKAVLKGGPLDGTYRLIQFHFHWGSLDGQGSEHTVDKKKYAAELHLVHWNTKYGDFGKAVQQPDGLAVLGIFLKVGSAKPGLQKVVDVLDSIKTKGKSADFTNFDPRGLLPESLDYWTYPGSLTTPPLLECVTWIVLKEPISVSSEQVLKFRKLNFNGEGEPEELMVDNWRPAQPLKNRQIKASFK

SEQ ID NO: 6101 - protein, 259 aa, Artificial Sequence
  source: /note="Description of Artificial Sequence: Synthetic Destabilizing Domain (DD)"
SHHWGYGKHNGPEHWHKDFPIAKGERQSPVDIDTHTAKYDPSLKPLSVSYDQATSLRILNNDHAFNVEFDDSQDKAVLKGGPLDGTYRLIQFHFHWGSLDGQGSEHTVDKKKYAAELHLVHWNTKYGDFGKAVQQPDGLAVLGIFLKVGSAKPGLQKVVDVLDSIKTKGKSADFTNFDPRGLLPESLDYWTYPGSLTTPPLLECVTWIVLKEPISVSSEQVLKFRKLNFNGEGEPEELMVDNWRPAQPLKNRQIKASFK

SEQ ID NO: 6102 - protein, 259 aa, Artificial Sequence
  source: /note="Description of Artificial Sequence: Synthetic Destabilizing Domain (DD)"
SHHWGYGKHNGPEHWHKDFPIAKGERQSPVDIDTHTAKYDPSLKPLSVSYDQATSLRILNNGHAFNVEFDDSQDKAVLKGGPLDGTYRLIQFHFHWGSLDGQGSEHTVDKKKYAAELHLVYWNTKYGDFGKAVQQPDGLAVLGIFLKVGSAKPGLQKVVDVLDSIKTKGKSADFTNFDPRGLLPESLDYWTYPGSLTTPPLLECVTWIVLKEPISVSSEQVLKFRKLNFNGEGEPEELMVDNWRPAQPLKNRQIKASFK

SEQ ID NO: 6103 - protein, 259 aa, Artificial Sequence; identical to SEQ ID NO: 5737
  source: /note="Description of Artificial Sequence: Synthetic Destabilizing Domain (DD)"

SEQ ID NO: 6104 - protein, 259 aa, Artificial Sequence; identical to SEQ ID NO: 5673
  source: /note="Description of Artificial Sequence: Synthetic Destabilizing Domain (DD)"

SEQ ID NO: 6105 - protein, 259 aa, Artificial Sequence; identical to SEQ ID NO: 5693
  source: /note="Description of Artificial Sequence: Synthetic Destabilizing Domain (DD)"

SEQ ID NO: 6106 - protein, 259 aa, Artificial Sequence; identical to SEQ ID NO: 5759
  source: /note="Description of Artificial Sequence: Synthetic Destabilizing Domain (DD)"

SEQ ID NO: 6107 - protein, 259 aa, Artificial Sequence
  source: /note="Description of Artificial Sequence: Synthetic Destabilizing Domain (DD)"
SHHWGYGKHNGPEHWHKDFPIAKGELQSPVDIDTHTAKYDPSLKPLSVSYDQATSLRILNNGHAFNVEFDDSQDKAVLKGGPLDGTYRLIQFHFHWGSLDGQGSEHTVDKKKYAAELHLVYWNTKYGDFGKAVQQPDGLAVLGIFLKVGSAKPGLQKVVDVLDSIKTKGKSADFTNFDPRGLLPESLDYWTYPGSLTTPPLLECVTWIVLKEPISVSSEQVLKFRKLNFNGEGEPEELMVDNWRPAQPLKNRQIKASFK

SEQ ID NO: 6108 - protein, 259 aa, Artificial Sequence
  source: /note="Description of Artificial Sequence: Synthetic Destabilizing Domain (DD)"
SHHWGYGKHNGPEHWHKDFPIAKGERQSPVDIDTHTAKYDPSLKPLSVSYDQATSLRILNNGHAFNVEFDDSQDKAVLKGGPLDGIYRLIQFHFHWGSLDGQGSEHTVDKKKYAAELHLVYWNTKYGDFGKAVQQPDGLAVLGIFLKVGSAKPGLQKVVDVLDSIKTKGKSADFTNFDPRGLLPESLDYWTYPGSLTTPPLLECVTWIVLKEPISVSSEQVLKFRKLNFNGEGEPEELMVDNWRPAQPLKNRQIKASFK

SEQ ID NO: 6109 - protein, 259 aa, Artificial Sequence
  source: /note="Description of Artificial Sequence: Synthetic Destabilizing Domain (DD)"
SHHWGYGKHNGPEHWHKDFPIAKGERQSPVDIDTHTAKYDPSLKPLSVSYDQATSLRILNNGHAFNVEFDDSQDKAVLKGGPLDGTYRLIQFHFHWGSLDGQGSEHTVDKKKYAAELHLVYWNTKYGDFGKAVQQPDGLAVLGIFLKVGSAKPGLQKVVDVLDSIKTKGKSADFTNFDPRGLLPESLDYWTYPGSLTTPPLLECVTWIVLKEPISVSSEQVLKFRKLNFNGEGEPEELMVDNWRPAQPLKDRQIKASFK

SEQ ID NO: 6110 - protein, 259 aa, Artificial Sequence
  source: /note="Description of Artificial Sequence: Synthetic Destabilizing Domain (DD)"
SHHWGYGKHNGPEHWHKDFPIAKGERQSPVDIDTHTAKYDPSLKPLSVSYDQATSLRILNNGHAFNVEFDFSQDKAVLKGGPLDGTYRLIQFHFHWGSLDGQGSEHTVDKKKYAAELHLVHWNTKYGDFGKAVQQPDGLAVLGIFLKVGSAKPGLQKVVDVLDSIKTKGKSADFTNFDPRGLLPESLDYWTYPGSLTTPPLLECVTWIVLKEPISVSSEQVLKFRKLNFNGEGEPEELMFDNWRPAQPLKNRQIKASFK

SEQ ID NO: 6111 - protein, 259 aa, Artificial Sequence
  source: /note="Description of Artificial Sequence: Synthetic Destabilizing Domain (DD)"
SHHWGYGKHNGPEHWHKDFPIAKGERQSPVDIDTHTAKYDPSLKPLSVSYDQATSLRILNNGHAFNVEFDDSQDKAVLKGGPLDGTYRLIQFHFHWGSLDGQGSEHTVDKKKYAAELHLVHWNTKYGDFGKAVQQPDGLAVLGIFLKVGSAKPGLQKVVDVLDSIKTKGKSADFTNFDPRGLLPESLDYWTYPGSLTTPPLLECVTWIVLKEPISVSSEQVLKFRKLNFNGEGEPEELMFDNWRPAQLLKNRQIKASFK

SEQ ID NO: 6112 - protein, 259 aa, Artificial Sequence
  source: /note="Description of Artificial Sequence: Synthetic Destabilizing Domain (DD)"
SHHWGYGKHNGPEHWHKDFPIAKGERQSPVDIDTHTAKYDPSLKPLSVSYDQATSLRILNNGHAFNVEFDFSQDKAVLKGGPLDGTYRLIQFHFHWGSLDGQGSEHTVDKKKYAAELHLVHWNTKYGDFGKAVQQPDGLAVLGIFLKVGSAKPGLQKVVDVLDSIKTKGKSADFTNFDPRGLLPESLDYWTYPGSLTTPPLLECVTWIVLKEPISVSSEQVLKFRKLNFNGEGEPEELMVDNWRPAQLLKNRQIKASFK

SEQ ID NO: 6113 - protein, 259 aa, Artificial Sequence
  source: /note="Description of Artificial Sequence: Synthetic Destabilizing Domain (DD)"
SHHWGYGKHNGPEHWHKDFPIAKGERQSPVDIDTHTAKYDPSLKPLSVSYDQATSLRILNNGHAFNVEFLDSQDKAVLKGGPLDGNYRLIQFHFHWGSLDGQGSEHTVDKKKYAAELHLVHWNTKYGDFGKAVQQPDGLAVLGIFLKVGSAKPGLQKVVDVLDSIKTKGKSADFTNFDPRGLLPESLDYWTYPGSLTTPPLLECVTWIVLKEPISVSSEQVLKFRKLNFNGEGEPEELMVDNWRPAQPLKNRQIKASFK

SEQ ID NO: 6114 - protein, 259 aa, Artificial Sequence
  source: /note="Description of Artificial Sequence: Synthetic Destabilizing Domain (DD)"
SHHWGYGKHNGPEHWHKDFPIAKGERQSPVDIDTHTAKYDPSLKPLSVSYDQATSLRILNNGHAFNVEFLDSQDKAVLKGGPLDGTYRLIQFHFHWGSLDGQGSEHTVDKKKYAAELHLVHWNTKYGDFGKAVQQPDGLAVLGIFLKVGSAKPGLQKVVDVLDSIKTKGKSADFTNFDPRGLLPESLDYWTYPGSLTTPPLLECVTWIVLKEPISVSSEQVLKFRKLNFNGEGEPEELMVDNWRPAQPRKNRQIKASFK

SEQ ID NO: 6115 - protein, 259 aa, Artificial Sequence; identical to SEQ ID NO: 5659
  source: /note="Description of Artificial Sequence: Synthetic Destabilizing Domain (DD)"

SEQ ID NO: 6116 - protein, 259 aa, Artificial Sequence; identical to SEQ ID NO: 5721
  source: /note="Description of Artificial Sequence: Synthetic Destabilizing Domain (DD)"

SEQ ID NO: 6117 - protein, 259 aa, Artificial Sequence; identical to SEQ ID NO: 5677
  source: /note="Description of Artificial Sequence: Synthetic Destabilizing Domain (DD)"

SEQ ID NO: 6118 - protein, 259 aa, Artificial Sequence
  source: /note="Description of Artificial Sequence: Synthetic Destabilizing Domain (DD)"
SHHWGYGKHNGPEHWHKDFPIAKGERQSPVDIDTHTAKYDPSLKPLSVSYDQAKSLRILNNNHAFNVEFDDSQDKAVLKGGPLDGTYRLIQFHFHWGSLDGQGSEHTVDKKKYAAELHLVHWNTKYGDFGKAVQQPDGLAVLGIFLKVGSAKPGLQKVVDVLDSIKTKGKSADFTNFDPRGLLPESLDYWTYPGSLTTPPLLECVTWIVLKEPISVSSEQVLKFRKLNFNGEGEPEELMVDNWRPANPLKNRQIKASFK

SEQ ID NO: 6119 - protein, 259 aa, Artificial Sequence; identical to SEQ ID NO: 5688
  source: /note="Description of Artificial Sequence: Synthetic Destabilizing Domain (DD)"

SEQ ID NO: 6120 - protein, 259 aa, Artificial Sequence; identical to SEQ ID NO: 5666
  source: /note="Description of Artificial Sequence: Synthetic Destabilizing Domain (DD)"

SEQ ID NO: 6121 - protein, 259 aa, Artificial Sequence; identical to SEQ ID NO: 5743
  source: /note="Description of Artificial Sequence: Synthetic Destabilizing Domain (DD)"

SEQ ID NO: 6122 - protein, 259 aa, Artificial Sequence; identical to SEQ ID NO: 5691
  source: /note="Description of Artificial Sequence: Synthetic Destabilizing Domain (DD)"

SEQ ID NO: 6123 - protein, 259 aa, Artificial Sequence; identical to SEQ ID NO: 5739
  source: /note="Description of Artificial Sequence: Synthetic Destabilizing Domain (DD)"

SEQ ID NO: 6124 - protein, 255 aa, Artificial Sequence
  source: /note="Description of Artificial Sequence: Synthetic Destabilizing Domain (DD)"
SHHWGYGKHNGPEHWHKDFPIAKGERQSPVDIDTHTAKYDPSLKPLSVSYDQATSLRILNNGHAFNVEFDDSQDKAVLKGGPLDGTYRLIQFHFHWGSLDGQGSEHTVDKKKYAAELHLVHWNTKYGDFGKAVQQPDGLAVLGIFLKVGSAKPGHQKVVDVLDSIKTKGKSADFTNFDPRGLLPESLDYWTYPGSLTTPPLLECVTWIVLKEPISVSSEQVLKFRKLNFNGEGEPEELMVDNWRPAQPLKNRQIK

SEQ ID NO: 6125 - protein, 255 aa, Artificial Sequence
  source: /note="Description of Artificial Sequence: Synthetic Destabilizing Domain (DD)"
GYGKHNGPEHWHKDFPIAKGERQSPVDIDTHTAKYDPSLKPLSVSYDQATSLRILNNGHAFNVEFDDSQDKAVLKGGPLDGTYRLIQFHFHWGSLDGQGSEHTVDKKKYAAELHLVHWNTKYGDFGKAVQQPDGLAVLGIFLKVGSAKPGHQKVVDVLDSIKTKGKSADFTNFDPRGLLPESLDYWTYPGSLTTPPLLECVTWIVLKEPISVSSEQVLKFRKLNFNGEGEPEELMVDNWRPAQPLKNRQIKASFK

SEQ ID NO: 6126 - protein, 259 aa, Artificial Sequence
  source: /note="Description of Artificial Sequence: Synthetic Destabilizing Domain (DD)"
SHHYGYGKHNGPEHWHKDFPIAKGERQSPVDIDTHTAKYDPSLKPLSVSYDQATSLRILNNGHAFNVEFDDSQDKAVLKGGPLDGTYRLIQFHFHWGSLDGQGSEHTVDKKKYAAELHLVHWNTKYGDFGKAVQQPDGLAVLGIFLKVGSAKPGHQKVVDVLDSIKTKGKSADFTNFDPRGLLPESLDYWTYPGSLTTPPLLECVTWIVLKEPISVSSEQVLKFRKLNFNGEGEPEELMVDNWRPAQPLKNRQIKASFK

SEQ ID NO: 6127 - protein, 256 aa, Artificial Sequence
  source: /note="Description of Artificial Sequence: Synthetic Destabilizing Domain (DD)"
SHHWGYGKHNGPEHWHKDFPIAKGERQSPVDIDTHTAKYDPSLKPLSVSYDQATSLRILNNGHAFNVEFDDSQDKAVLKGGPLDGTYRLIQFHFHWGSLDGQGSEHTVDKKKYAAELHLVHWNTKYGDFGKAVQQPDGLAVLGIFLKVGSAKPGHQKVVDVLDSIKTKGKSADFTNFDPRGLLPESLDYWTYPGSLTTPPLLECVTWIVLKEPISVSSEQVLKFRKLNFNGEEELMVDNWRPAQPLKNRQIKASFK

SEQ ID NO: 6128 - protein, 259 aa, Artificial Sequence
  source: /note="Description of Artificial Sequence: Synthetic Destabilizing Domain (DD)"
SHHWGYGKHNGPEHWHKDFPIAKGERQSPVDIDTHTAKYDPSLKPLSVSYDQATSLRILNNGHAFNVEFDDSQDKAVLKGGPLDGTYRLIQFHFHWGSLDGQGSEHTVDKKKYAAELHLVHWNTKYGDFGKAVQQPDGLAVLGIFLKVGSAKPGHQKVVDVLDSIKTKGKSADFTNFDPRGLLPESLDYWTYPGSLTTPPLLECVTWIVLKEPISVSSEQVLKLRKLNFNGEGEPEELMVDNWRPAQPLKNRQIKASFK

SEQ ID NO: 6129 - protein, 259 aa, Artificial Sequence
  source: /note="Description of Artificial Sequence: Synthetic Destabilizing Domain (DD)"
SHHWGYGKHNGPEHWHKDFPIAKGERQSPVDIDTHTAKYDPSLKPLSVSYDQATSLRILNNGHAFNVEFNDSQNKAVLKGGPLDGTYRLIQFHFHWGSLNGQGSEHTVDKKKYAAELHLVHWNTKYGDFGKAVQQPDGLAVLGIFLKVGSAKPGHQKVVDVLDSIKTKGKSADFTNFDPRGLLPESLDYWTYPGSLTTPPLLECVTWIVLKEPISVSSEQVLKFRKLNFNGEGEPEELMVDNWRPAQPLKNRQIKASFK

SEQ ID NO: 6130 - DNA, 777 bp, Artificial Sequence
  source: /note="Description of Artificial Sequence: Synthetic Destabilizing Domain (DD)"
tcccatcactgggggtacggcaaacacaacggacctgagcactggcataaggacttccccattgccaagggagagcgccagtcccctgttgacatcgacactcatacagccaagtatgacccttccctgaagcccctgtctgtttcctatgatcaagcaacttccctgaggatcctcaacaatggtcatgctttcaacgtggagtttgatgactctcaggacaaagcagtgctcaagggaggacccctggatggcacttacagattgattcagtttcactttcactggggttcacttgatggacaaggttcagaccatactgtggataaaaagaaatatgctgcagaacttcacttggttcactggaacaccaaatatggggattttgggaaagctgtgcagcaacctgatggactggccgttctaggtatttttttgaaggttggcagcgctaaaccgggccttcagaaagttgttgatgtgctggattccattaaaacaaagggcaagagtgctgacttcactaacttcgatcctcgtggcctccttcctgaatccctggattactggacctacccaggctcactgaccacccctcctcttctggaatgtgtgacctggattgtgctcaaggaacccatcagcgtcagcagcgagcaggtgttgaaattccgtaaacttaacttcaatggggagggtgaacccgaagaactgatggtggacaactggcgcccagctcagccactgaagaacaggcaaatcaaagcttccttcaaa

SEQ ID NO: 6131 - DNA, 777 bp, Artificial Sequence; identical to SEQ ID NO: 5814
  source: /note="Description of Artificial Sequence: Synthetic Destabilizing Domain (DD)"

SEQ ID NO: 6132 - DNA, 777 bp, Artificial Sequence; identical to SEQ ID NO: 5880
  source: /note="Description of Artificial Sequence: Synthetic Destabilizing Domain (DD)"

SEQ ID NO: 6133 - DNA, 777 bp, Artificial Sequence; identical to SEQ ID NO: 5876
  source: /note="Description of Artificial Sequence: Synthetic Destabilizing Domain (DD)"

SEQ ID NO: 6134 - DNA, 777 bp, Artificial Sequence; identical to SEQ ID NO: 5816
  source: /note="Description of Artificial Sequence: Synthetic Destabilizing Domain (DD)"

SEQ ID NO: 6135 - DNA, 777 bp, Artificial Sequence; identical to SEQ ID NO: 5822
  source: /note="Description of Artificial Sequence: Synthetic Destabilizing Domain (DD)"

SEQ ID NO: 6136 - DNA, 777 bp, Artificial Sequence
  source: /note="Description of Artificial Sequence: Synthetic Destabilizing Domain (DD)"
tcccatcactgggggtacggcaaacacaacggacctgagcactggcataaggacttccccattgccaagggagagcgccagtcccctgttgacatcgacactcatacagccaagtatgacccttccctgaagcccctgtctgtttcctatgatcaagcaacttccctgaggaacctcaacaatggtcatgctttcaacgtggagtttgatgactctcaggacaaagcagtgctcaagggaggacccctggatggcacttacagattgattcagtttcactttcactggggttcacttgatggacaaggttcagagcatactgtggataaaaagaaatatgctgcagaacttcacttggttcactggaacaccaaatatggggattttgggaaagctgtgcagcaacctgatggactggccgttctaggtatttttttgaaggttggcagcgctaaaccgggccttcagaaagttgttgatgtgctggattccattaaaacaaagggcaagagtgctgacttcactaacttcgatcctcgtggcctccttcctgaatccctggattactggacctacccaggctcactgaccacccctcctcttctggaatgtgtgacctggattgtgctcaaggaacccatcagcgtcagcagcgagcaggtgttgaaattccgtaaacttaacttcaatggggagggtgaacccgaagaactgatggtggacaactggcgcccagctcagccactgaagaacaggcaaatcaaagcttccttcaaa

SEQ ID NO: 6137 - DNA, 777 bp, Artificial Sequence
  source: /note="Description of Artificial Sequence: Synthetic Destabilizing Domain (DD)"
tcccatcactgggggtacggcaaacacaacggacctgagcactggcataaggacttccccattgccaagggagagcgccagtcccctgttgacatcgacactcatacagccaagtatgacccttccctgaagcccctgtctgtttcctatgatcaagcaacttccctgaggatcctcaacaatgatcatgctttcaacgtggagtttgatgactctcaggacaaagcagtgctcaagggaggacccctggatggcacttacagattgattcagtttcactttcactggggttcacttgatggacaaggttcagagcatactgtggataaaaagaaatatgctgcagaacttcacttggttcactggaacaccaaatatggggattttgggaaagctgtgcagcaacctgatggactggccgttctaggtatttttttgaaggttggcagcgctaaaccgggccttcagaaagttgttgatgtgctggattccattaaaacaaagggcaagagtgctgacttcactaacttcgatcctcgtggcctccttcctgaatccctggattactggacctacccaggctcactgaccacccctcctcttctggaatgtgtgacctggattgtgctcaaggaacccatcagcgtcagcagcgagcaggtgttgaaattccgtaaacttaacttcaatggggagggtgaacccgaagaactgatggtggacaactggcgcccagctcagccactgaagaacaggcaaatcaaagcttccttcaaa

SEQ ID NO: 6138 - DNA, 777 bp, Artificial Sequence
  source: /note="Description of Artificial Sequence: Synthetic Destabilizing Domain (DD)"
tcccatcactgggggtacggcaaacacaacggacctgagcactggcataaggacttccccattgccaagggagagcgccagtcccctgttgacatcgacactcatacagccaagtatgacccttccctgaagcccctgtctgtttcctatgatcaagcaacttccctgaggatcctcaacaatggtcatgctttcaacgtggagtttgatgactctcaggacaaagcagtgctcaagggaggacccctggatggcacttacagattgattcagtttcactttcactggggttcacttgatggacaaggttcagagcatactgtggataaaaagaaatatgctgcagaacttcacttggtttactggaacaccaaatatggggattttgggaaagctgtgcagcaacctgatggactggccgttctaggtatttttttgaaggttggcagcgctaaaccgggccttcagaaagttgttgatgtgctggattccattaaaacaaagggcaagagtgctgacttcactaacttcgatcctcgtggcctccttcctgaatccctggattactggacctacccaggctcactgaccacccctcctcttctggaatgtgtgacctggattgtgctcaaggaacccatcagcgtcagcagcgagcaggtgttgaaattccgtaaacttaacttcaatggggagggtgaacccgaagaactgatggtggacaactggcgcccagctcagccactgaagaacaggcaaatcaaagcttccttcaaa

SEQ ID NO: 6139 - DNA, 777 bp, Artificial Sequence
  source: /note="Description of Artificial Sequence: Synthetic Destabilizing Domain (DD)"
tcccatcactgggggtacggcaaacacaacggacctgagcactggcataaggacttccccattgccaagggagagcgccagtcccctgttgacatcgacactcatacagccaagtatgacccttccctgaagcccctgtctgtttcctatgatcaagcaacttccctgaggatcctcaacaatgatcatgctttcaacgtggagtttgatgactctcaggacaaagcagtgctcaagggaggacccctggatggcacttacagattgattcagtttcactttcactggggttcacttgatggacaaggttcagagcatactgtggataaaaagaaatatgctgcagaacttcacttggttcactggaacaccaaatatggggattttgggaaagctgtgcagcaacctgatggactggccgttctaggtatttttttgaaggttggcagcgctaaaccgggccttcagaaagttgttgatgtgctggattccattaaaacaaagggcaagagtgctgacttcactaacttcgatcctcgtggcctccttcctgaatccctggattactggacctacccaggctcactgaccacccctcctcttctggaatgtgtgacctggattgtgctcaaggaacccatcagcgtcagcagcgagcaggtgttgaaattccgtaaacttaacttcaatggggagggtgaacccgaagaactgcttgtggacaactggcgcccagctcagccactgaagaacaggcaaatcaaagcttccttcaaa

SEQ ID NO: 6140 - DNA, 777 bp, Artificial Sequence
  source: /note="Description of Artificial Sequence: Synthetic Destabilizing Domain (DD)"
tcccatcactgggggtacggcaaacacaacggacctgagcactggcataaggacttccccattgccaagggagagcgccagtcccctgttgacatcgacactcatacagccaagtatgacccttccctgaagcccctgtctgtttcctatgatcaagcaacttccctgaggatcctcaacaatggtcatgctttcaacgtggagtttgatgactctcaggacaaaattgtgctcaagggaggacccctggatggcacttacagattgattcagtttcactttcactggggttcacttgatggacaaggttcagagcatactgtggataaaaagaaatatgctgcagaacttcacttggttcactggaacaccaaatatggggattttgggaaagctgtgcagcaacctgatggactggccgttctaggtatttttttgaaggttggcagcgctaaaccgggccttcagaaagttgttgatgtgctggattccattaaaacaaagggcaagagtgctgacttcactaacttcgatcctcgtggcctccttcctgaatccctggattactggacctacccaggctcactgaccacccctcctcttctggaatgtgtgacctggattgtgctcaaggaacccatcagcgtcagcagcgagcaggtgttgaaattccgtaaacttaacttcaatggggagggtgaacccgaagaactgatggtggacaactggcgcccagctcagtttctgaagaacaggcaaatcaaagcttccttcaaa

SEQ ID NO: 6141 - DNA, 777 bp, Artificial Sequence; identical to SEQ ID NO: 5694
  source: /note="Description of Artificial Sequence: Synthetic Destabilizing Domain (DD)"

SEQ ID NO: 6142 - DNA, 777 bp, Artificial Sequence; identical to SEQ ID NO: 5760
  source: /note="Description of Artificial Sequence: Synthetic Destabilizing Domain (DD)"

SEQ ID NO: 6143 - DNA, 777 bp, Artificial Sequence
  source: /note="Description of Artificial Sequence: Synthetic Destabilizing Domain (DD)"
tcccatcactgggggtacggcaaacacaacggacctgagcactggcataaggacttccccattgccaagggagagctccagtcccctgttgacatcgacactcatacagccaagtatgacccttccctgaagcccctgtctgtttcctatgatcaagcaacttccctgaggatcctcaacaatggtcatgctttcaacgtggagtttgatgactctcaggacaaagcagtgctcaagggaggacccctggatggcacttacagattgattcagtttcactttcactggggttcacttgatggacaaggttcagagcatactgtggataaaaagaaatatgctgcagaacttcacttggtttactggaacaccaaatatggggattttgggaaagctgtgcagcaacctgatggactggccgttctaggtatttttttgaaggttggcagcgctaaaccgggccttcagaaagttgttgatgtgctggattccattaaaacaaagggcaagagtgctgacttcactaacttcgatcctcgtggcctccttcctgaatccctggattactggacctacccaggctcactgaccacccctcctcttctggaatgtgtgacctggattgtgctcaaggaacccatcagcgtcagcagcgagcaggtgttgaaattccgtaaacttaacttcaatggggagggtgaacccgaagaactgatggtggacaactggcgcccagctcagccactgaagaacaggcaaatcaaagcttccttcaaa

SEQ ID NO: 6144 - DNA, 777 bp, Artificial Sequence
  source: /note="Description of Artificial Sequence: Synthetic Destabilizing Domain (DD)"
tcccatcactgggggtacggcaaacacaacggacctgagcactggcataaggacttccccattgccaagggagagcgccagtcccctgttgacatcgacactcatacagccaagtatgacccttccctgaagcccctgtctgtttcctatgatcaagcaacttccctgaggatcctcaacaatggtcatgctttcaacgtggagtttgatgactctcaggacaaagcagtgctcaagggaggacccctggatggcatttacagattgattcagtttcactttcactggggttcacttgatggacaaggttcagagcatactgtggataaaaagaaatatgctgcagaacttcacttggtttactggaacaccaaatatggggattttgggaaagctgtgcagcaacctgatggactggccgttctaggtatttttttgaaggttggcagcgctaaaccgggccttcagaaagttgttgatgtgctggattccattaaaacaaagggcaagagtgctgacttcactaacttcgatcctcgtggcctccttcctgaatccctggattactggacctacccaggctcactgaccacccctcctcttctggaatgtgtgacctggattgtgctcaaggaacccatcagcgtcagcagcgagcaggtgttgaaattccgtaaacttaacttcaatggggagggtgaacccgaagaactgatggtggacaactggcgcccagctcagccactgaagaacaggcaaatcaaagcttccttcaaa

SEQ ID NO: 6145 - DNA, 777 bp, Artificial Sequence
  source: /note="Description of Artificial Sequence: Synthetic Destabilizing Domain (DD)"
tcccatcactgggggtacggcaaacacaacggacctgagcactggcataaggacttccccattgccaagggagagcgccagtcccctgttgacatcgacactcatacagccaagtatgacccttccctgaagcccctgtctgtttcctatgatcaagcaacttccctgaggatcctcaacaatggtcatgctttcaacgtggagtttgatgactctcaggacaaagcagtgctcaagggaggacccctggatggcacttacagattgattcagtttcactttcactggggttcacttgatggacaaggttcagagcatactgtggataaaaagaaatatgctgcagaacttcacttggtttactggaacaccaaatatggggattttgggaaagctgtgcagcaacctgatggactggccgttctaggtatttttttgaaggttggcagcgctaaaccgggccttcagaaagttgttgatgtgctggattccattaaaacaaagggcaagagtgctgacttcactaacttcgatcctcgtggcctccttcctgaatccctggattactggacctacccaggctcactgaccacccctcctcttctggaatgtgtgacctggattgtgctcaaggaacccatcagcgtcagcagcgagcaggtgttgaaattccgtaaacttaacttcaatggggagggtgaacccgaagaactgatggtggacaactggcgcccagctcagccactgaaggacaggcaaatcaaagcttccttcaaa

SEQ ID NO: 6146 - DNA, 777 bp, Artificial Sequence
  source: /note="Description of Artificial Sequence: Synthetic Destabilizing Domain (DD)"
tcccatcactgggggtacggcaaacacaacggacctgagcactggcataaggacttccccattgccaagggagagcgccagtcccctgttgacatcgacactcatacagccaagtatgacccttccctgaagcccctgtctgtttcctatgatcaagcaacttccctgaggatcctcaacaatggtcatgctttcaacgtggagtttgatttctctcaggacaaagcagtgctcaagggaggacccctggatggcacttacagattgattcagtttcactttcactggggttcacttgatggacaaggttcagagcatactgtggataaaaagaaatatgctgcagaacttcacttggttcactggaacaccaaatatggggattttgggaaagctgtgcagcaacctgatggactggccgttctaggtatttttttgaaggttggcagcgctaaaccgggccttcagaaagttgttgatgtgctggattccattaaaacaaagggcaagagtgctgacttcactaacttcgatcctcgtggcctccttcctgaatccctggattactggacctacccaggctcactgaccacccctcctcttctggaatgtgtgacctggattgtgctcaaggaacccatcagcgtcagcagcgagcaggtgttgaaattccgtaaacttaacttcaatggggagggtgaacccgaagaactgatgtttgacaactggcgcccagctcagccactgaagaacaggcaaatcaaagcttccttcaaa

SEQ ID NO: 6147 - DNA, 777 bp, Artificial Sequence
  source: /note="Description of Artificial Sequence: Synthetic Destabilizing Domain (DD)"
tcccatcactgggggtacggcaaacacaacggacctgagcactggcataaggacttccccattgccaagggagagcgccagtcccctgttgacatcgacactcatacagccaagtatgacccttccctgaagcccctgtctgtttcctatgatcaagcaacttccctgaggatcctcaacaatggtcatgctttcaacgtggagtttgatgactctcaggacaaagcagtgctcaagggaggacccctggatggcacttacagattgattcagtttcactttcactggggttcacttgatggacaaggttcagagcatactgtggataaaaagaaatatgctgcagaacttcacttggttcactggaacaccaaatatggggattttgggaaagctgtgcagcaacctgatggactggccgttctaggtatttttttgaaggttggcagcgctaaaccgggccttcagaaagttgttgatgtgctggattccattaaaacaaagggcaagagtgctgacttcactaacttcgatcctcgtggcctccttcctgaatccctggattactggacctacccaggctcactgaccacccctcctcttctggaatgtgtgacctggattgtgctcaaggaacccatcagcgtcagcagcgagcaggtgttgaaattccgtaaacttaacttcaatggggagggtgaacccgaagaactgatgtttgacaactggcgcccagctcagctactgaagaacaggcaaatcaaagcttccttcaaa

SEQ ID NO: 6148 - DNA, 777 bp, Artificial Sequence
  source: /note="Description of Artificial Sequence: Synthetic Destabilizing Domain (DD)"
tcccatcactgggggtacggcaaacacaacggacctgagcactggcataaggacttccccattgccaagggagagcgccagtcccctgttgacatcgacactcatacagccaagtatgacccttccctgaagcccctgtctgtttcctatgatcaagcaacttccctgaggatcctcaacaatggtcatgctttcaacgtggagtttgatttctctcaggacaaagcagtgctcaagggaggacccctggatggcacttacagattgattcagtttcactttcactggggttcacttgatggacaaggttcagagcatactgtggataaaaagaaatatgctgcagaacttcacttggttcactggaacaccaaatatggggattttgggaaagctgtgcagcaacctgatggactggccgttctaggtatttttttgaaggttggcagcgctaaaccgggccttcagaaagttgttgatgtgctggattccattaaaacaaagggcaagagtgctgacttcactaacttcgatcctcgtggcctccttcctgaatccctggattactggacctacccaggctcactgaccacccctcctcttctggaatgtgtgacctggattgtgctcaaggaacccatcagcgtcagcagcgagcaggtgttgaaattccgtaaacttaacttcaatggggagggtgaacccgaagaactgatggtggacaactggcgcccagctcagctactgaagaacaggcaaatcaaagcttccttcaaa

SEQ ID NO: 6149 - DNA, 777 bp, Artificial Sequence
  source: /note="Description of Artificial Sequence: Synthetic Destabilizing Domain (DD)"
tcccatcactgggggtacggcaaacacaacggacctgagcactggcataaggacttccccattgccaagggagagcgccagtcccctgttgacatcgacactcatacagccaagtatgacccttccctgaagcccctgtctgtttcctatgatcaagcaacttccctgaggatcctcaacaatggtcatgctttcaacgtggagtttcttgactctcaggacaaagcagtgctcaagggaggacccctggatggcaattacagattgattcagtttcactttcactggggttcacttgatggacaaggttcagagcatactgtggataaaaagaaatatgctgcagaacttcacttggttcactggaacaccaaatatggggattttgggaaagctgtgcagcaacctgatggactggccgttctaggtatttttttgaaggttggcagcgctaaaccgggccttcagaaagttgttgatgtgctggattccattaaaacaaagggcaagagtgctgacttcactaacttcgatcctcgtggcctccttcctgaatccctggattactggacctacccaggctcactgaccacccctcctcttctggaatgtgtgacctggattgtgctcaaggaacccatcagcgtcagcagcgagcaggtgttgaaattccgtaaacttaacttcaatggggagggtgaacccgaagaactgatggtggacaactggcgcccagctcagccactgaagaacaggcaaatcaaagcttccttcaaa

SEQ ID NO: 6150 - DNA, 777 bp, Artificial Sequence
  source: /note="Description of Artificial Sequence: Synthetic Destabilizing Domain (DD)"
tcccatcactgggggtacggcaaacacaacggacctgagcactggcataaggacttccccattgccaagggagagcgccagtcccctgttgacatcgacactcatacagccaagtatgacccttccctgaagcccctgtctgtttcctatgatcaagcaacttccctgaggatcctcaacaatggtcatgctttcaacgtggagtttcttgactctcaggacaaagcagtgctcaagggaggacccctggatggcacttacagattgattcagtttcactttcactggggttcacttgatggacaaggttcagagcatactgtggataaaaagaaatatgctgcagaacttcacttggttcactggaacaccaaatatggggattttgggaaagctgtgcagcaacctgatggactggccgttctaggtatttttttgaaggttggcagcgctaaaccgggccttcagaaagttgttgatgtgctggattccattaaaacaaagggcaagagtgctgacttcactaacttcgatcctcgtggcctccttcctgaatccctggattactggacctacccaggctcactgaccacccctcctcttctggaatgtgtgacctggattgtgctcaaggaacccatcagcgtcagcagcgagcaggtgttgaaattccgtaaacttaacttcaatggggagggtgaacccgaagaactgatggtggacaactggcgcccagctcagccacggaagaacaggcaaatcaaagcttccttcaaa

SEQ ID NO: 6151 - DNA, 777 bp, Artificial Sequence; identical to SEQ ID NO: 5661
  source: /note="Description of Artificial Sequence: Synthetic Destabilizing Domain (DD)"

SEQ ID NO: 6152 - DNA, 777 bp, Artificial Sequence; identical to SEQ ID NO: 5722
  source: /note="Description of Artificial Sequence: Synthetic Destabilizing Domain (DD)"

SEQ ID NO: 6153 - DNA, 777 bp, Artificial Sequence; identical to SEQ ID NO: 5678
  source: /note="Description of Artificial Sequence: Synthetic Destabilizing Domain (DD)"

SEQ ID NO: 6154 - DNA, 777 bp, Artificial Sequence
  source: /note="Description of Artificial Sequence: Synthetic Destabilizing Domain (DD)"
tcccatcactgggggtacggcaaacacaacggacctgagcactggcataaggacttccccattgccaagggagagcgccagtcccctgttgacatcgacactcatacagccaagtatgacccttccctgaagcccctgtctgtttcctatgatcaagcaaagtccctgaggatcctcaacaataatcatgctttcaacgtggagtttgatgactctcaggacaaagcagtgctcaagggaggacccctggatggcacttacagattgattcagtttcactttcactggggttcacttgatggacaaggttcagagcatactgtggataaaaagaaatatgctgcagaacttcacttggttcactggaacaccaaatatggggattttgggaaagctgtgcagcaacctgatggactggccgttctaggtatttttttgaaggttggcagcgctaaaccgggccttcagaaagttgttgatgtgctggattccattaaaacaaagggcaagagtgctgacttcactaacttcgatcctcgtggcctccttcctgaatccctggattactggacctacccaggctcactgaccacccctcctcttctggaatgtgtgacctggattgtgctcaaggaacccatcagcgtcagcagcgagcaggtgttgaaattccgtaaacttaacttcaatggggagggtgaacccgaagaactgatggtggacaactggcgcccagctaatccactgaagaacaggcaaatcaaagcttccttcaaa

SEQ ID NO: 6155 - DNA, 777 bp, Artificial Sequence; identical to SEQ ID NO: 5689
  source: /note="Description of Artificial Sequence: Synthetic Destabilizing Domain (DD)"

SEQ ID NO: 6156 - DNA, 777 bp, Artificial Sequence; identical to SEQ ID NO: 5668
  source: /note="Description of Artificial Sequence: Synthetic Destabilizing Domain (DD)"

SEQ ID NO: 6157 - DNA, 777 bp, Artificial Sequence; identical to SEQ ID NO: 5744
  source: /note="Description of Artificial Sequence: Synthetic Destabilizing Domain (DD)"

SEQ ID NO: 6158 - DNA, 777 bp, Artificial Sequence; identical to SEQ ID NO: 5692
  source: /note="Description of Artificial Sequence: Synthetic Destabilizing Domain (DD)"

SEQ ID NO: 6159 - DNA, 777 bp, Artificial Sequence; identical to SEQ ID NO: 5740
  source: /note="Description of Artificial Sequence: Synthetic Destabilizing Domain (DD)"

SEQ ID NO: 6160 - DNA, 765 bp, Artificial Sequence
  source: /note="Description of Artificial Sequence: Synthetic Destabilizing Domain (DD)"
tcccatcactgggggtacggcaaacacaacggacctgagcactggcataaggacttccccattgccaagggagagcgccagtcccctgttgacatcgacactcatacagccaagtatgacccttccctgaagcccctgtctgtttcctatgatcaagcaacttccctgaggatcctcaacaatggtcatgctttcaacgtggagtttgatgactctcaggacaaagcagtgctcaagggaggacccctggatggcacttacagattgattcagtttcactttcactggggttcacttgatggacaaggttcagagcatactgtggataaaaagaaatatgctgcagaacttcacttggttcactggaacaccaaatatggggattttgggaaagctgtgcagcaacctgatggactggccgttctaggtatttttttgaaggttggcagcgctaaaccgggccatcagaaagttgttgatgtgctggattccattaaaacaaagggcaagagtgctgacttcactaacttcgatcctcgtggcctccttcctgaatccctggattactggacctacccaggctcactgaccacccctcctcttctggaatgtgtgacctggattgtgctcaaggaacccatcagcgtcagcagcgagcaggtgttgaaattccgtaaacttaacttcaatggggagggtgaacccgaagaactgatggtggacaactggcgcccagctcagccactgaagaacaggcaaatcaaa

SEQ ID NO: 6161 - DNA, 765 bp, Artificial Sequence
  source: /note="Description of Artificial Sequence: Synthetic Destabilizing Domain (DD)"
gggtacggcaaacacaacggacctgagcactggcataaggacttccccattgccaagggagagcgccagtcccctgttgacatcgacactcatacagccaagtatgacccttccctgaagcccctgtctgtttcctatgatcaagcaacttccctgaggatcctcaacaatggtcatgctttcaacgtggagtttgatgactctcaggacaaagcagtgctcaagggaggacccctggatggcacttacagattgattcagtttcactttcactggggttcacttgatggacaaggttcagagcatactgtggataaaaagaaatatgctgcagaacttcacttggttcactggaacaccaaatatggggattttgggaaagctgtgcagcaacctgatggactggccgttctaggtatttttttgaaggttggcagcgctaaaccgggccatcagaaagttgttgatgtgctggattccattaaaacaaagggcaagagtgctgacttcactaacttcgatcctcgtggcctccttcctgaatccctggattactggacctacccaggctcactgaccacccctcctcttctggaatgtgtgacctggattgtgctcaaggaacccatcagcgtcagcagcgagcaggtgttgaaattccgtaaacttaacttcaatggggagggtgaacccgaagaactgatggtggacaactggcgcccagctcagccactgaagaacaggcaaatcaaagcttccttcaaa

SEQ ID NO: 6162 - DNA, 777 bp, Artificial Sequence
  source: /note="Description of Artificial Sequence: Synthetic Destabilizing Domain (DD)"
tcccatcactacgggtacggcaaacacaacggacctgagcactggcataaggacttccccattgccaagggagagcgccagtcccctgttgacatcgacactcatacagccaagtatgacccttccctgaagcccctgtctgtttcctatgatcaagcaacttccctgaggatcctcaacaatggtcatgctttcaacgtggagtttgatgactctcaggacaaagcagtgctcaagggaggacccctggatggcacttacagattgattcagtttcactttcactggggttcacttgatggacaaggttcagagcatactgtggataaaaagaaatatgctgcagaacttcacttggttcactggaacaccaaatatggggattttgggaaagctgtgcagcaacctgatggactggccgttctaggtatttttttgaaggttggcagcgctaaaccgggccatcagaaagttgttgatgtgctggattccattaaaacaaagggcaagagtgctgacttcactaacttcgatcctcgtggcctccttcctgaatccctggattactggacctacccaggctcactgaccacccctcctcttctggaatgtgtgacctggattgtgctcaaggaacccatcagcgtcagcagcgagcaggtgttgaaattccgtaaacttaacttcaatggggagggtgaacccgaagaactgatggtggacaactggcgcccagctcagccactgaagaacaggcaaatcaaagcttccttcaaa

SEQ ID NO: 6163 - DNA, 768 bp, Artificial Sequence
  source: /note="Description of Artificial Sequence: Synthetic Destabilizing Domain (DD)"
tcccatcactgggggtacggcaaacacaacggacctgagcactggcataaggacttccccattgccaagggagagcgccagtcccctgttgacatcgacactcatacagccaagtatgacccttccctgaagcccctgtctgtttcctatgatcaagcaacttccctgaggatcctcaacaatggtcatgctttcaacgtggagtttgatgactctcaggacaaagcagtgctcaagggaggacccctggatggcacttacagattgattcagtttcactttcactggggttcacttgatggacaaggttcagagcatactgtggataaaaagaaatatgctgcagaacttcacttggttcactggaacaccaaatatggggattttgggaaagctgtgcagcaacctgatggactggccgttctaggtatttttttgaaggttggcagcgctaaaccgggccatcagaaagttgttgatgtgctggattccattaaaacaaagggcaagagtgctgacttcactaacttcgatcctcgtggcctccttcctgaatccctggattactggacctacccaggctcactgaccacccctcctcttctggaatgtgtgacctggattgtgctcaaggaacccatcagcgtcagcagcgagcaggtgttgaaattccgtaaacttaacttcaatggggaggaagaactgatggtggacaactggcgcccagctcagccactgaagaacaggcaaatcaaagcttccttcaaa

SEQ ID NO: 6164 - DNA, 777 bp, Artificial Sequence
  source: /note="Description of Artificial Sequence: Synthetic Destabilizing Domain (DD)"
tcccatcactgggggtacggcaaacacaacggacctgagcactggcataaggacttccccattgccaagggagagcgccagtcccctgttgacatcgacactcatacagccaagtatgacccttccctgaagcccctgtctgtttcctatgatcaagcaacttccctgaggatcctcaacaatggtcatgctttcaacgtggagtttgatgactctcaggacaaagcagtgctcaagggaggacccctggatggcacttacagattgattcagtttcactttcactggggttcacttgatggacaaggttcagagcatactgtggataaaaagaaatatgctgcagaacttcacttggttcactggaacaccaaatatggggattttgggaaagctgtgcagcaacctgatggactggccgttctaggtatttttttgaaggttggcagcgctaaaccgggccatcagaaagttgttgatgtgctggattccattaaaacaaagggcaagagtgctgacttcactaacttcgatcctcgtggcctccttcctgaatccctggattactggacctacccaggctcactgaccacccctcctcttctggaatgtgtgacctggattgtgctcaaggaacccatcagcgtcagcagcgagcaggtgttgaaactccgtaaacttaacttcaatggggagggtgaacccgaagaactgatggtggacaactggcgcccagctcagccactgaagaacaggcaaatcaaagcttccttcaaa

SEQ ID NO: 6165 - DNA, 777 bp, Artificial Sequence
  source: /note="Description of Artificial Sequence: Synthetic Destabilizing Domain (DD)"
tcccatcactgggggtacggcaaacacaacggacctgagcactggcataaggacttccccattgccaagggagagcgccagtcccctgttgacatcgacactcatacagccaagtatgacccttccctgaagcccctgtctgtttcctatgatcaagcaacttccctgaggatcctcaacaatggtcatgctttcaacgtggagtttaatgactctcagaacaaagcagtgctcaagggaggacccctggatggcacttacagattgattcagtttcactttcactggggttcacttaatggacaaggttcagagcatactgtggataaaaagaaatatgctgcagaacttcacttggttcactggaacaccaaatatggggattttgggaaagctgtgcagcaacctgatggactggccgttctaggtatttttttgaaggttggcagcgctaaaccgggccatcagaaagttgttgatgtgctggattccattaaaacaaagggcaagagtgctgacttcactaacttcgatcctcgtggcctccttcctgaatccctggattactggacctacccaggctcactgaccacccctcctcttctggaatgtgtgacctggattgtgctcaaggaacccatcagcgtcagcagcgagcaggtgttgaaattccgtaaacttaacttcaatggggagggtgaacccgaagaactgatggtggacaactggcgcccagctcagccactgaagaacaggcaaatcaaagcttccttcaaa

The invention claimed is:

1. A polypeptide comprising an effector module, said effector module comprising:

a. a stimulus response element (SRE), wherein the SRE comprises a drug responsive domain (DRD), said DRD comprising human carbonic anhydrase 2 (CA2; SEQ ID NO. 5810) or a region thereof, wherein the region of human CA2 corresponds to amino acids 2 to 260 of SEQ ID NO. 5810; and wherein the DRD comprises a mutation or set of mutations selected the group consisting of:

(i) a R27L mutation in the amino acid at position 27 (R27) of SEQ ID NO. 5810, a T87I mutation in the amino acid at position 87 (T87) of SEQ ID NO. 5810, a N252D mutation in the amino acid at position 252 (N252) of SEQ ID NO. 5810, and a H122Y mutation in the amino acid position 122 (H122) of SEQ ID NO:5810;

(ii) a I59N mutation in the amino acid at position 59 (I59) of SEQ ID NO. 5810;

(iii) a G102R mutation in the amino acid at position 102 (G102) of SEQ ID NO. 5810;

(iv) a L156H mutation in the amino acid at position 156 (L156) of SEQ ID NO. 5810;

(v) four mutations relative to SEQ ID NO. 5810, said mutations corresponding to:

(a) L156H, S172C, F178Y, and E186D, or (b) D70N, D74N, D100N, and L156H;

(vi) one or more mutations relative to SEQ ID NO. 5810, said mutations corresponding to:

(a) G63D (b) G63D and M240L

G63D, E69V and N231I, or

T55K, G63N and Q248N; and (vii) two or more mutations relative to SEQ ID NO. 5810, said two or more mutations corresponding to: D72F and V241F, D72F and P249L, D72F and P249F, D72F, V241F and P249L, A77I and P249F, or V241F and P249L;

and b. at least one payload which is operably linked to the SRE, wherein the payload comprises a membrane-associated Interleukin 12 (IL12), wherein the membrane-associated IL 12 is a fusion protein comprising an IL12 subunit beta (p40), an IL12 subunit alpha (p35), at least one linker, and a transmembrane domain, wherein the p40 comprises an amino acid sequence selected from SEQ ID NO: 4, SEQ ID NO. 5763, or SEQ ID NO. 5774, and wherein the p35 comprises an amino acid sequence selected from SEQ ID NO: 1, SEQ ID NO. 5777 or SEQ ID NO. 5798.

2. The polypeptide of claim 1, wherein the DRD comprises:

(i) a R27L mutation in the amino acid at position 27 (R27) of SEQ ID NO. 5810;

(ii) a T87I mutation in the amino acid at position 87 (T87) of SEQ ID NO. 5810;

(iii) a N252D mutation in the amino acid at position 252 (N252) of SEQ ID NO. 5810; and (iv) a H122Y mutation in the amino acid position 122 (H122) of SEQ ID NO: 5810.

3. The polypeptide of claim 1, wherein the DRD comprises a 159N mutation in the amino acid at position 59 (159) of SEQ ID NO. 5810.

4. The polypeptide of claim 3, wherein the DRD further comprises a G102R mutation in the amino acid at position 102 (G102) of SEQ ID NO. 5810.

5. The polypeptide of claim 1, wherein the DRD comprises a L156H mutation in the amino acid at position 156 (L156) of SEQ ID NO. 5810.

6. The polypeptide of claim 5, wherein the DRD comprises four mutations relative to SEQ ID NO. 5810, said mutations corresponding to:

(i) L156H, S172C, F178Y, and E186D; or (ii) D70N, D74N, D100N, and L156H.

7. The polypeptide of claim 1, wherein the DRD comprises one or more substitutions relative to SEQ ID NO. 5810, wherein at least one substitution is a substitution of D or N at the amino acid position 63 (G63) of SEQ ID NO. 5810, and wherein the one or more substitutions correspond to:

G63D;

G63D and M240L;

G63D, E69V and N231I; or

T55K, G63N and Q248N.

8. The polypeptide of claim 1, wherein the DRD comprises two or more substitutions relative to SEQ ID NO. 5810, wherein at least one of the two or more substitutions is:

(i) a substitution of F at the amino acid position 241 (V241) of SEQ ID NO. 5810; or (ii) a substitution of F or L at the amino acid position 249 (P249) of SEQ ID NO. 5810; and wherein the two or more substitutions correspond to:

D72F and V241F;

D72F and P249L;

D72F and P249F;

D72F, V241F and P249L;

A77I and P249F; or

V241F and P249L.

9. The polypeptide of claim 1, wherein the DRD comprises the region of human CA2 corresponding to amino acids 2 to 260 of SEQ ID NO. 5810.

10. The polypeptide of claim 1, wherein the DRD comprises the region of human CA2 corresponding to full-length CA2 comprising amino acids 1 to 260 of SEQ ID NO. 5810.

11. The polypeptide of claim 1, wherein the SRE is responsive to one or more stimuli.

12. The polypeptide of claim 11, wherein the stimulus is a small molecule, wherein the small molecule is selected from Acetazolamide, Celecoxib, Valdecoxib, Rofecoxib, Methazolamide, Dorzolamide, Brinzolamide, Diclofenamide, Ethoxzolamide, Zonisamide, Dansylamide, or Dichlorphenamide.

13. The polypeptide of claim 12, wherein the small molecule is Acetazolamide.

14. The polypeptide of claim 1, wherein the fusion protein comprises, from the N-terminus, p40-linker-p35-transmembrane domain.

15. The polypeptide of claim 14, wherein the fusion protein further comprises a second linker between p35 and the transmembrane domain.

16. The polypeptide of claim 1, wherein the membrane-associated IL12 further comprises a leader sequence.

17. The polypeptide of claim 16, wherein the leader sequence comprises an amino acid sequence selected from SEQ ID NO. 3024 or SEQ ID NO. 6006.

18. The polypeptide of claim 1, wherein the transmembrane domain is selected from a CD8α transmembrane domain or a B7-1 transmembrane domain.

19. The polypeptide of claim 1, wherein the membrane-associated IL12 further comprises a hinge domain.

20. The polypeptide of claim 19, wherein the hinge domain is selected from a CD8α hinge domain or a B7-1 hinge domain.

21. The polypeptide of claim 1, wherein the at least one linker comprises one or more Glycine (G) and/or Serine(S) residues.

22. The polypeptide of claim 1, wherein the at least one linker comprises a B7-1 C2 domain or an IgG1 Fc domain.

23. The polypeptide of claim 1, wherein the membrane-associated IL 12 further comprises a cytoplasmic tail domain.

24. The polypeptide of claim 23, wherein the cytoplasmic tail domain is selected from a CD8α tail, a B7-1 tail, and a 4-1BB intracellular domain.

25. The polypeptide of claim 1, wherein the DRD is C-terminally located to the payload.

26. The polypeptide of claim 1, wherein the DRD is separated from the payload by a linker.

27. The polypeptide of claim 1, wherein the effector module polypeptide further comprises a signal peptide, a targeting and/or penetrating peptide, a linker, a protein tag, and/or a protein cleavage site.

* * * * *